(12) United States Patent
Moussy et al.

(10) Patent No.: US 10,238,649 B2
(45) Date of Patent: Mar. 26, 2019

(54) USE OF MASITINIB FOR TREATMENT OF CANCER IN PATIENT SUBPOPULATIONS IDENTIFIED USING PREDICTOR FACTORS

(71) Applicant: AB SCIENCE, Paris (FR)

(72) Inventors: Alain Moussy, Paris (FR); Jean-Pierre Kinet, Lexington, MA (US)

(73) Assignee: AB SCIENCE, Paris (FR)

( * ) Notice: Subject to any disclaimer, the term of this patent is extended or adjusted under 35 U.S.C. 154(b) by 161 days.

(21) Appl. No.: 14/433,198

(22) PCT Filed: Oct. 4, 2013

(86) PCT No.: PCT/EP2013/070741
§ 371 (c)(1),
(2) Date: Apr. 2, 2015

(87) PCT Pub. No.: WO2014/053650
PCT Pub. Date: Apr. 10, 2014

(65) Prior Publication Data
US 2015/0272945 A1    Oct. 1, 2015

(30) Foreign Application Priority Data
Oct. 4, 2012   (EP) .................................. 12306214

(51) Int. Cl.
| A61K 45/06 | (2006.01) |
| A61K 31/496 | (2006.01) |
| C12Q 1/6886 | (2018.01) |
| A61K 31/7068 | (2006.01) |

(52) U.S. Cl.
CPC ........ *A61K 31/496* (2013.01); *A61K 31/7068* (2013.01); *A61K 45/06* (2013.01); *C12Q 1/6886* (2013.01); *C12Q 2600/106* (2013.01); *C12Q 2600/158* (2013.01)

(58) Field of Classification Search
None
See application file for complete search history.

(56) References Cited

U.S. PATENT DOCUMENTS

| 7,423,055 B2 | 9/2008 | Ciufolini et al. |
| 2009/0298061 A1 | 12/2009 | Wirtz |
| 2011/0201620 A1* | 8/2011 | Ciufolini ............. C07D 277/42 514/253.1 |
| 2012/0309706 A1 | 12/2012 | Moussy et al. |

FOREIGN PATENT DOCUMENTS

| EP | 1525200 | 10/2007 |
| WO | 2004-014903 | 2/2004 |
| WO | 2007015935 | 2/2007 |
| WO | 2008/084103 | 7/2008 |
| WO | 2008098949 | 8/2008 |
| WO | 2008115300 | 9/2008 |
| WO | 2011056963 | 5/2011 |
| WO | 2011092338 | 8/2011 |
| WO | WO 2011/092338 | * 8/2011 |
| WO | 2012170640 | 12/2012 |

OTHER PUBLICATIONS

Mitry (Cancer Chemother Pharmacol 2010 vol. 66 pp. 395-403).*
Hameed (Cancers 2011, 3, 43-60).*
Humbert (PloS ONE 5(3): e9430 Mar. 4, 2010).*
Burris (Journal of Clinical Oncology vol. 15 No. 6 Jun. 1997 pp. 2403-2413).*
Seattle Cancer Care Alliance "RADIANT: A Study of Tarceva After Surgery With or Without Adjuvant Chemotherapy in NSCLC Patients Who Have EGFR-Positive Tumors", NCT00373425, 2006, 2 pages.
Aaronson et al, "The European Organization for Research and Treatment of Cancer QLQ-C30: a quality-of-life instrument for use in international clinical trials in oncology" J Natl Cancer Inst. 1993, 85(5):365-76.
Almholt et al, "Stromal cell involvement in cancer" Recent Results Cancer Res. 2003, 162:31-42.
Chang et al, "Mast cells in tumor microenvironment promotes the in vivo growth of pancreatic ductal adenocarcinoma" Clin Cancer Res. 2011, 17(22):7015-23.
Conroy et al, "FOLFIRINOX versus gemcitabine for metastatic pancreatic cancer" N Engl J Med. 2011, 364(19):1817-25.
Davis et al, "Comprehensive analysis of kinase inhibitor selectivity" Nat Biotechnol. 2011, 29(11):1046-51.
Dubreuil et al, "Masitinib (AB1010), a potent and selective tyrosine kinase inhibitor targeting KIT" PLoS One. 2009, 4(9):e7258.
Galinsky et al, "Mast cells and cancer—no longer just basic science" Crit Rev Oncol Hematol. 2008, 68(2):115-30.
Gilfillan et al, "Integrated signalling pathways for mast-cell activation" Nat Rev Immunol. 2006, 6(3):218-30.
Gilfillan et al, "The tyrosine kinase network regulating mast cell activation" Immunological Reviews. 2009, 228(1):149-69.
Gooch et al, "Interleukin 4 inhibits growth and induces apoptosis in human breast cancer cells" Cancer Res. 1998, 15:4199-205.

(Continued)

*Primary Examiner* — Amanda Haney
(74) *Attorney, Agent, or Firm* — Young & Thompson

(57) ABSTRACT

A method for treating patients afflicted with cancer, wherein the patients are treated with a compound including tyrosine kinase inhibitor, mast cell inhibitor or c-Kit inhibitor, in particular masitinib, optionally in combination with at least one antineoplastic agent. The tyrosine kinase inhibitor, mast cell inhibitor or c-Kit inhibitor, and the optional at least one antineoplastic agent, are administered in a dosage regimen that includes a therapeutically effective amount. Also described are methods for predicting therapeutic response to the treatment in a given patient and therefore identification of applicable patient subpopulations based upon these predictor factors; sometimes referred to as biomarkers. One method is based upon the clinical marker of pain intensity. Another method is based upon gene expression predictive biomarkers assessed via RNA expression in peripheral blood cell samples collected prior to treatment with the compound, which is also used for treating patients afflicted with pancreatic cancer.

Figure 1:
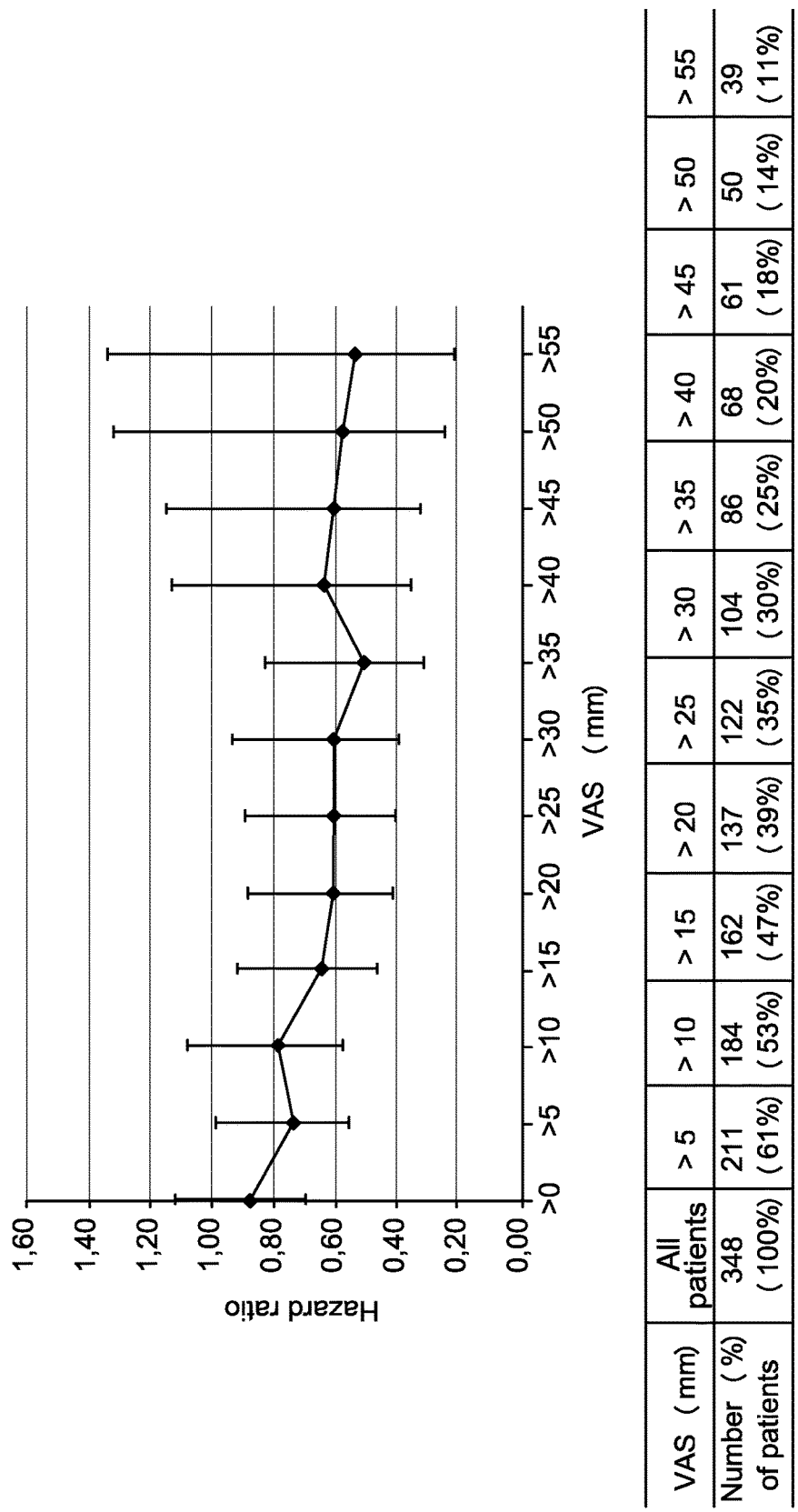

11 Claims, 6 Drawing Sheets
Specification includes a Sequence Listing.

(56) References Cited

OTHER PUBLICATIONS

Grimbaldeston et al, "High dermal mast cell prevalence is a predisposing factor for basal cell carcinoma in humans" J Invest Dermatol. 2000, 115:(2)317-20.
Grimbaldeston et al, "Association between melanoma and dermal mast cell prevalence in sun-unexposed skin" Br J Dermatol. 2004, 150(5):895-903.
Hameed et al, "Pain Management in Pancreatic Cancer" Cancers. 2011,3(1):43-60.
Hermine et al, "Case-control cohort study of patients' perceptions of disability in mastocytosis" PLoS One. 2008,(5)3: e2266.
Jensen et al, In: Chapman CR, Foley KM, eds: Current and Emerging Issues in Cancer Pain: Research and Practice. New York, NY: Raven Press, 1993, pp. 193-218.
Jensen, "The validity and reliability of pain measures in adults with cancer" J Pain. 2003, 4(1):2-21.
Marineo, "Untreatable pain resulting from abdominal cancer: new hope from biophysics?" J Pancreas. 2003,4(1):1-10.
Mitry et al, "Safety and activity of masitinib in combination with gemcitabine in patients with advanced pancreatic cancer" Cancer Chemother Pharmacol. 2010, 66(2):395-403.
Moore et al, "Erlotinib plus gemcitabine compared with gemcitabine alone in patients with advanced pancreatic cancer: a phase III trial of the National Cancer Institute of Canada Clinical Trials Group" J Clin Oncol. 2007, 25(15):1960-6.
Ribatti et al, "The controversial role of mast cells in tumor growth" Int Rev Cell Mol Biol. 2009, 275:89-131.
Samoszuk et al, "Degranulating mast cells in fibrotic regions of human tumors and evidence that mast cell heparin interferes with the growth of tumor cells through a mechanism involving fibroblasts" BMC Cancer. 2005, 21:121.
Schmidt et al, "Mechanism of cancer pain" Mol Interv. 2010, 10(3):164-78.
Thamm et al, "Masitinib as a chemosensitizer of canine tumor cell lines: a proof of concept study" The Veterinary Journal. 2012, 191(1):131-4.
Theoharides et al, "Mast cells: the Jekyll and Hyde of tumor growth" Trends Immunol. 2004, 25(5):235-41.
Zaza et al, "Cancer pain and psychosocial factors: a critical review of the literature" J Pain Symptom Manage. 2002, 24(5):526-42.
International Search Report, dated Jan. 30, 2014, in corresponding International Patent Application No. PCT/EP2013/070741.
Gang Zhou et al., "Detection and Clinical Significance of CD44v6 and Integrin-B1 in Pancreatic Cancer Patients using a Triplex Real-Time RT-PCR Assay," Applied Biochemistry and Biotechnology; Part A: Enzyme Engineering and Biotechnology, Humana Press Inc, vol. 167, No. 8, Jun. 14, 2012, pp. 2257-2268.
Humbert et al., "Masitinib combined with standard gemcitabine chemotherapy: in vitro and in vivo studies in human pancreatic tumor cell lines and ectopic mouse model", Plos One, Public Library of Science, US, vol. 5, No. 3, Jan. 1, 2010, pp. e9430-e9431.
Business Wire, "AB Science reported phase 3 study results of masitinib in combination with Gemzar for treatment of pancreatic cancer." Oct. 30, 2012.
Hoffmann et al. "High expression of HIF1a is a predictor of clinical outcome in patients with pancreatic ductal adenocarcinomas and correlated to PDGFA, VEGF, and bFGF." Neoplasia. 2008, 10(7):674-649.
Fujita et al. "Gene expression levels as predictive markers of outcome in pancreatic cancer after gemcitabine-based adjuvant chemotherapy." Neoplasia. 2010, 12(10):807-817.
Lowery et al. "Pancreatic cancer: the role of molecular markers in diagnosis and management." Clinical Advances in Hematology & Oncology. 2011, 9(12):900-908.
O'Reilly et al. "Postresection surveillance for pancreatic cancer performance status, imaging, and serum markers." Cancer Journal. 2012, 18(6):609-613.
Konig et al. "Expression and localization of human multidrug resistance protein (ABCC) family members in pancreatic carcinoma." International Journal of Cancer. 2005, 115(3):359-367.
Piquemal et al, "Transcriptome analysis of monocytic leukemia cell differentiation" Genomics. 2002, 80(3):361-71.
Clinical Trials US AB Science AB07012—https://clinicaltrials.gov/ct2/show/NCT00789633.
Clinical Trials EU Register AB Science AB07012 (Feb. 19, 2009)—https://www.clinicaltrialsregister.eu/ctr-search/trial/2008-000974-18/CZ.

* cited by examiner

USE OF MASITINIB FOR TREATMENT OF CANCER IN PATIENT SUBPOPULATIONS IDENTIFIED USING PREDICTOR FACTORS

The present invention relates to a method for treating patients afflicted with cancer, wherein said patients are treated with a tyrosine kinase inhibitor, mast cell inhibitor or c-Kit inhibitor, in particular masitinib, optionally in combination with at least one antineoplastic agent. The tyrosine kinase inhibitor, mast cell inhibitor or c-Kit inhibitor, and the optional at least one antineoplastic agent, are administered in a dosage regimen that comprises a therapeutically effective amount. The present invention also relates to methods for predicting therapeutic response to said treatment in a given patient and therefore identification of applicable patient subpopulations based upon these predictor factors; sometimes referred to as predictive biomarkers. One method is based upon the clinical marker of pain intensity. The second method is based upon gene expression predictive biomarkers assessed via RNA expression in peripheral blood cell samples collected prior to treatment with a compound of the invention (i.e. a tyrosine kinase inhibitor, mast cell inhibitor or c-Kit inhibitor, especially masitinib). Advantageously, the present invention relates to a method for treating patients afflicted with pancreatic cancer wherein said patients are treated with a tyrosine kinase inhibitor, mast cell inhibitor or c-Kit inhibitor, and in particular masitinib, optionally in combination with at least one antineoplastic agent, and in particular gemcitabine.

BACKGROUND OF THE INVENTION

The Role of Mast Cells in Tumor Microenvironment, Tumorigenesis, and Cancer Pain Throughout the process of tumorigenesis, disease progression, and metastasis, the microenvironment of the local host tissue is an active participant and determines the extent of cancer cell proliferation, angiogenesis, invasion, and survival. The role of mast cells in the tumorigenesis of cancers is not well understood, however it is hypothetically possible that mast cell activation facilitates the growth and spread of some cancers by producing molecules that enhance tumor invasiveness. For example, mast cells have been directly linked to the development of pancreatic cancer tumorigenesis in mouse models, showing that high levels of mast cell infiltration into the tumor microenvironment was predictive of poor clinical outcome, although the exact mechanism by which mast cells contribute to pancreatic cancer development was not clear [Chang D Z et al., Clin Cancer Res 2011; 17:7015-7023]. Hence, inhibition of mast cell function may prove to be of therapeutic benefit in restraining the growth of cancers for which there is sufficient mast cell involvement.

Exactly which cancers would benefit from targeting mast cell activity is however largely unknown or controversial. There exists conflicting data about whether mast cells benefit or hinder tumorigenesis, depending on the local stromal conditions and if the mediators released facilitate the proliferation of tumor cells or induce the apoptosis of malignant cells [(Theoharides T C, et al., Trends Immunol 2004; 25:235-41); (Samoszuk M, et al., BMC Cancer 2005; 21:121); (Almholt K, et al., Recent Results Cancer Res 2003; 162:31-42); (Gooch J L, et al., Cancer Res 1998; 15:4199-205)]. Moreover, consistent with the dual roles of mast cells in inhibiting or promoting tumor growth, high mast cell numbers have been shown to represent a good prognostic indicator in breast cancer, non-small cell lung carcinoma, and ovarian cancer [(Galinsky D S, et al. Crit Rev Oncol Hematol 2008; 68:115-30); (Ribatti D, et al., Int Rev Cell Mol Biol 2009; 275:89-131)], but they are associated with poor prognosis in skin cancer (both melanoma and nonmelanoma and Merkel cell tumors) [Grimbaldeston M A, et al., Br J Dermatol 2004; 150:895-903); (Grimbaldeston M A, et al., J Invest Dermatol 2000; 115:317-20)], oral squamous cell carcinoma, several types of lymphoma, and prostate cancer [(Galinsky D S, et al., Crit Rev Oncol Hematol 2008; 68:115-30); (Ribatti D, et al., Int Rev Cell Mol Biol 2009; 275:89-131)]. It also remains unclear whether mast cell density or the degree of mast cell activation represents the key consideration in mast cell related symptoms, these two aspects not necessarily correlating with one another [Hermine O, et al., PLoS ONE. 2008; 3:e2266].

Mast cells are associated with diverse disease related pain and are emerging as having a role in cancer pain. Mast cells have been linked to the pathogenesis of pain in conditions for which pain is a predominant symptom but is considered to be out of proportion to the objective pathological findings, i.e. indicating that anatomical abnormalities cannot alone account for the pain; examples include chronic pancreatitis, interstitial cystitis, and irritable bowel syndrome. Each of these conditions has been associated with an increased number of mast cells in the pancreas, bladder, or colon, respectively, as compared with those patients without disease related pain. Although the etiology of cancer pain remains unclear, the current understanding indicates that within the cancer microenvironment, cancer and immune cells produce and secrete mediators that activate and sensitize primary afferent nociceptors. Schmidt at al. reviewed the mechanisms of cancer pain [Schmidt B L, et al., Mol Interv. 2010 June; 10(3):164-78], summarizing the symptoms experienced by the cancer patient as being a consequence of cellular, tissue, and systemic changes that occur during proliferation, invasion, and metastasis, with the responding immune system also having a clear role in cancer pain.

Thus, although there is evidence for diverse, indirect mast cell involvement in tumorigenesis (i.e. as opposed to mast cells themselves being the proliferating cancer cell) and also cancer pain, its heterogeneous and disparate nature precludes any clear approach as to how targeting mast cell activity could have a therapeutic impact for cancer patients; one preferably manifested as an augmentation of survival time. This is equally true for those cancers having an established association with increased mast cell involvement, such as pancreatic cancer.

Cancer Pain and Pharmacotherapy Pain Control

The etiology of cancer pain is complex and remains poorly understood. Cancer pain can be severe and debilitating, drastically reducing quality-of-life in patients who already have an attenuated life expectancy. Considering in particular pancreatic cancer, abdominal and back pain is a significant complication with nearly 75% of unrespectable pancreatic cancer patients suffering from pain at the time of diagnosis, increasing to more than 90% of patients in advanced disease [Hameed M, et al., Cancers 2011, 3, 43-60]. Pain in pancreatic cancer may be visceral, somatic, or neuropathic in origin and is produced by tissue damage, inflammation, ductal obstruction, and infiltration. Visceral nociceptive pain is caused by damage to the upper abdominal viscera, structures that are particularly sensitive to stretch, ischemia and inflammation, which typically produces a poorly localized, diffuse pain. Somatic and neuropathic pain may arise from tumor extension into the surrounding peritoneum, retroperitoneum, bones and in the latter case, nerves such as the lumbosacral plexus.

Opioid analgesics are commonly used to manage cancer pain, their mechanism of action being to act directly on the central nervous system. However, this can also lead to unwanted side effects, such as constipation, drowsiness, dizziness, breathing problems, and physical or mental dependence. The World Health Organization (WHO) has published a standardized approach for analgesic drug regimens administered for the control of chronic cancer pain in the form of an "analgesic ladder" [Available online: www.who.int/cancer/palliative/painladder/en/ (accessed on 13 Mar. 2012)]. This model recommends that if pain occurs, there should be prompt oral administration of drugs in the following order: "nonopioids such as paracetamol for mild pain; then, as necessary, mild opioids such as codeine for mild to moderate pain; then strong opioids such as morphine for moderate to severe pain, until the patient is free of pain. To calm fears and anxiety, adjuvants drugs should be used. To maintain freedom from pain drugs should be administered on regular schedule, that is every 3-6 hours rather than on-demand". This stepwise approach is based on the severity of pain and less on the pathophysiologic process of pain, although it has been recommended that to increase the efficacy of available therapeutic modalities, the multiple types of pain generating processes in cancer (visceral, somatic, and neuropathic) should also be taken into consideration [Hameed M, et al., Cancers 2011, 3, 43-60].

Assessment of Cancer Pain and Quality-of-Life in Cancer Patients

In order to assess and record cancer pain the clinician must select appropriate assessment instruments and procedures. However, there is currently no universally accepted cancer pain assessment tool or consensus even on what such a tool should assess. As a consequence there is great diversity of dimensions and items used in the existing tools, which can affect the validity of pain assessment in general and also makes comparisons between studies difficult. Pain assessment tools may be unidimensional or multidimensional. Based upon literature reviews and expert working groups' opinions, it is generally agreed that single item unidimensional tools are among the most frequently used pain assessment tools in cancer patients. Moreover, for simple assessment of changes in pain intensity and for assessment of pain intensity in clinical settings, Visual Analogue Scale (VAS) based tools have been proven to be psychometrically satisfactory [Jensen, M P, et al., J Pain 2003; 4(1): 2e21]. Unidimensional pain assessment tools include the numeric rating scale (0 is "no pain" and 10 is "worst pain imaginable"); a verbal descriptor scale ("no pain," "mild pain," "moderate pain," "severe pain"); or a visual analogue scale (a 100 mm line with anchors such as "no pain" on the left and "worst pain imaginable" on the right) on which the patient indicates the place on the line that best represents the intensity of pain). Each scale has its strengths and weaknesses; however, most self-report measures of pain intensity are strongly related to one another and can be used interchangeably in many situations, especially when clear instructions and an opportunity for practice has been given.

Subjective pain can be categorized into at least four specific factors: pain intensity, pain affect, pain relief, and pain quality [Jensen, M P, et al., In: Chapman C R, Foley K M, eds.: Current and Emerging Issues in Cancer Pain: Research and Practice. New York, N.Y.: Raven Press, 1993, pp. 193-218]. Pain intensity reflects how much a person hurts, and is the most important factor of pain for the purpose of describing the present invention. For a patient, the rating of pain intensity is a magnitude estimation task. Patients are usually able to provide pain intensity estimates relatively quickly, and measures of pain intensity tend to be closely related to one another statistically. Pain intensity can therefore be viewed as a fairly homogeneous dimension that is relatively easy for most people to gauge. The three most commonly used methods for assessing pain intensity are the Verbal Rating Scale, the Visual Analogue Scale (VAS), and the Numerical Rating Scale. Less commonly used measures include the Behavior Rating Scale, the Picture Scale, the Box Scale, and the Descriptor Differential nScale [Jensen, M P, et al., In: Chapman C R, Foley K M, eds.: Current and Emerging Issues in Cancer Pain: Research and Practice. New York, N.Y.: Raven Press, 1993, pp. 193-218].

Visual Analogue Scales are probably the most frequently used instrument for assessment of pain intensity in the setting of treatment related outcome research. VASs consist of a line, usually 10 cm long, whose ends are labeled as the extremes of pain (for example, "no pain" to "pain as bad as it could be"). If a VAS has specific points along the line that are labeled with intensity-denoting adjectives or numbers, it is referred to as a Graphic Rating Scale of Pain Intensity. Patients are simply asked to indicate which point along the line best represents their pain intensity. Usually, the pain assessor allows the patient to practice using the measure to be sure that the assessment task is understood. The distance from the no pain end to the mark made by the patient is that patient's pain intensity score. There is much evidence supporting the validity of VASs of pain intensity. VASs are directly correlated with other self-report measures of pain intensity, as well as to observed pain behavior [see Jensen, 1993 and references contained therein]. Because VASs are usually measured in millimeters they have a large number of response categories, i.e. the scale can be considered as having 101 points, making it potentially more sensitive to changes in pain intensity than measures with limited numbers of response categories. Research indicates that VASs of pain intensity are usually (but not always) more sensitive to treatment change than are 4- or 5-point Verbal Rating Scale.

Multidimensional pain assessment tools (also sometimes referred to as pain assessment questionnaires) provide a measure of clinical pain that captures its sensory, affective and other qualitative components that extends beyond the basic measure of pain intensity. Theoretically, multidimensional tools should be more reliable and therefore potentially more sensitive for detecting changes in pain associated with time or with treatment; however, they are more complex and lengthy to complete than unidimensional tools. Furthermore, because multidimensional pain or quality-of-life (QOL) assessment tools were generally designed to evaluate change of health related QOL in a clinical trial setting, their scores are only informative when used in a comparative setting, i.e. comparing treatment arms, and therefore, a single individual score is not considered to be informative. Examples of the main multidimensional pain or quality-of-life (QOL) assessment tools used in cancer pain assessment include: the European Organization for Research and Treatment of Cancer 30-item core quality-of-life questionnaire (EORTC QLQ C-30); the Brief Pain Inventory (BPI); and the McGill Pain Questionnaire.

Considering pancreatic cancer in particular, then the EORTC multidimensional tool is arguably the most applicable, although this has yet to be proven in practice. The EORTC QLQ C-30 is a 30-item self-reporting questionnaire developed to assess the quality-of-life of cancer patients [Aaronson, N K et al., J Natl Cancer Inst 85(5): 365-76, 1993]. Importantly, it is supplemented by disease specific modules, including a module specific to pancreatic cancer (QLQ-PAN26), which includes 26 items related to disease symptoms, treatment side-effects and emotional issues. The QLQ-C30 questionnaire has been validated but the QLQ-PAN26 module is not yet validated as it still needs to undergo psychometric testing in a large international group of patients.

In general, the added complexity and patient burden associated with implementation of multidimensional tools outweigh its advantages when the objective is to measure cancer pain intensity or classify patients according to this parameter. Hence, unidimensional tools remain the most appropriate pain assessment option available for the purpose of describing pain in the present invention.

Gene Expression Profiling and Identification of Treatment Subpopulations

Alterations in the genome that lead to a variety of chromosomal aberrations are a characteristic of all malignant tumors. In addition to gene mutations, tumor growth is also sustained by an altered level of gene expression. Gene expression profiling is the measurement of the expression (i.e. activity) of thousands of genes simultaneously, to create a global picture of cellular function or a genetic 'fingerprint' of a particular physiological/pathological sample. In the context of cancer, gene expression profiling has been used to more accurately classify tumors; furthermore, comparison of expression profiles can identify subpopulations in which genes are consistently up-regulated or down-regulated. Hence, the information derived from gene expression profiling has the potential to make an objective diagnosis, to identify genes that correlate with survival, to provide risk assessment of premalignant lesions, and to predict responses to certain treatments. In the latter example, one can answer questions of direct clinical significance such as the probability of a patient to respond to a drug given said patient's genetic fingerprint.

Pancreatic Cancer Overview

The pancreas contains exocrine cells (involved in the production of enzymes important for food digestion) and endocrine cells (that produce hormones such as insulin). Both exocrine and endocrine cells can form tumors, but those formed by the exocrine pancreas are far more common and are associated with a very poor prognosis. The vast majority of exocrine pancreatic tumors are adenocarcinomas. Tumors of the endocrine pancreas (also known as islet cell tumors) are far less common and mostly benign in nature.

Cancer of the exocrine pancreas (referred to hereafter as pancreatic cancer) is a seriously life threatening condition. In most cases, early stages of the disease are asymptomatic and less than 20% of pancreatic cancers are amenable to surgery. Of those patients undergoing tumor resection, only 20% will survive 5 years. Early diagnosis of pancreatic cancer is difficult because symptoms vary and are nonspecific. Symptoms are primarily caused by mass effect rather than disruption of exocrine or endocrine functions and depend on the tumor's size and location, as well as the presence of metastases. Cancers that begin in the head of the pancreas are near the common bile duct. These cancers can compress the duct while they are still fairly small, which may possibly lead to jaundice and allow these tumors to be found in an earlier stage. Cancers that begin in the body or tail of the pancreas do not compress the duct until they have spread through the pancreas. By this time, the cancer may have also spread beyond the pancreas, frequently the liver, which also leads to jaundice. All symptoms commonly associated to pancreatic cancer can have multiple other causes, further complicating diagnosis with the consequence that pancreatic cancer is frequently diagnosed at an advanced stage. Moreover, invasive and metastatic pancreatic cancers respond poorly to existing treatments in chemotherapy and radiotherapy, with high levels of carbohydrate antigen 19-9 (CA 19-9), and an Eastern Cooperative Oncology Group (ECOG) status $\geq 2$ also being associated with a poor prognosis. Mortality rate remains obstinately high over the past few decades, with patients receiving standard treatment having a median survival after diagnosis of respectively, 3-6 months and 9-12 months for patients with metastatic and locally advanced disease. The overall 5-year survival rate is below 5%.

Treatment of Adenocarcinoma Pancreatic Cancer

Treatment of pancreatic cancer depends on the stage of the cancer, as described in Table 1. When the disease is confined to the pancreas and clearly separated from surrounding blood vessels (i.e. it is local and respectable), the treatment of choice is surgery with postoperative chemotherapy and/or radiation. When the disease encases or compresses surrounding blood vessels or has extended into adjacent structures (i.e., locally advanced and unresectable), chemotherapy and/or radiation is proposed. In rare cases, when the patient responds well to treatment, the tumor may subsequently be surgically resected. When the disease has spread to distant organs (i.e., metastatic), chemotherapy is proposed. In most cases, these treatments do not represent a cure.

TABLE 1

Staging and treatment of pancreatic cancer

| Stage | Description | Pancreatic cancer cases | Treatment options | Median survival |
| --- | --- | --- | --- | --- |
| Local or resectable | Disease is confined to the pancreas and is clearly separated from surrounding blood vessels | 15% | Surgery; postoperative chemotherapy and/or radiation may also be offered | 11-18 months |
| Locally advanced or unresectable | Disease encases or compresses surrounding blood vessels, or has directly extended into adjacent structures | 40% | Chemotherapy (most commonly gemcitabine-based) and/or radiation. In very rare instances, cancers that respond well to initial treatment may subsequently be surgically resected. | 10-12 months |

TABLE 1-continued

Staging and treatment of pancreatic cancer

| Stage | Description | Pancreatic cancer cases | Treatment options | Median survival |
|---|---|---|---|---|
| Metastatic | Evidence of extrapancreatic spread to distant organs (liver, lungs, etc.) | 45% | Chemotherapy (most commonly gemcitabine-based); investigational trials | 5-7 months |

Chemotherapy may be used in patients with advanced unresectable cancer (locally advanced or metastatic) and in patients with localized disease after surgery or even as a neoadjuvant treatment to shrink the tumor before surgery. For decades, 5-fluorouracil (5-FU) was the most widely used chemotherapeutic agent in metastatic pancreatic cancer until a randomized study showed symptom benefit and prolongation of survival of gemcitabine (Gemzar®, Lilly France), over 5-Fluorouracil (5-FU). Gemcitabine, a nucleoside analogue of cytidine, is now established as the standard systemic treatment for patients with locally advanced, unresectable, or metastatic pancreatic adenocarcinoma. However, the efficacy of gemcitabine as a single agent remains modest, with a median survival of approximately 6 months in randomized trials and a 12-month survival of approximately 20%. The antimetabolite gemcitabine (CAS number 95058-81-4; (4-amino-1-[3,3-difluoro-4-hydroxy-5-(hydroxymethyl)tetrahydrofuran-2-yl]-1H-pyrimidin-2-one) replaces cytidine during DNA replication resulting in apoptosis in cancer cells. Gemcitabine has the following formula:

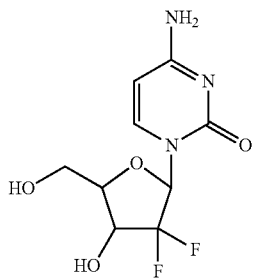 [SMILES: Nc1ccn(C2OC(CO)C(O)C2(F)F)c(=O)n1]

To date, numerous clinical trials have explored the combination of gemcitabine with either cytotoxic and/or biological targeted compounds, however results have almost universally been disappointing, showing little or no benefit compared with gemcitabine monotherapy. The causes of pancreatic cancer are not well understood but as differences between pancreatic cancer cells and normal cells are uncovered, newer drugs are trying to exploit these differences by attacking only specific targets. Thus, attention is increasingly being directed towards the role of growth factors. Several growth factors and their receptors are overexpressed during the progression of pancreatic cancer, such as epithelial growth factor (EGF), platelet-derived growth factor (PDGF), fibroblast growth factor (FGF), and vascular endothelial growth factor (VEGF). Deregulated expression of cytoplasmic tyrosine kinases has also been associated with poor prognosis and chemoresistance. In particular, gemcitabine resistance in pancreatic cancer is often associated with high expression of focal adhesion kinase (FAK), a protein involved in metastasis; and elevated expression and activity of Src Family Kinases (SFK), including SRC and Lyn, have also been reported in numerous human cancer cell lines and tumor tissues. Moreover, evidence indicates that recruitment of inflammatory cells, including infiltration by mast cells, facilitates the growth and spread of cancer via the production of molecules that enhance tumor invasiveness.

The epidermal growth factor receptor (EGFR) is the target of several drugs under development, including erlotinib (Tarceva®), the combination of which with gemcitabine has been approved as first-line treatment for patients with unresectable pancreatic cancer. This combination was found to modestly extend survival in a clinical trial, with a median OS (6.24 months) 2 weeks longer than for gemcitabine monotherapy (5.91 months), and 1-year survival rate of 23% (c.f. 17% for gemcitabine monotherapy treatment arm; p=0.023) [Moore M J, et al., J Clin Oncol. 2007 May 20; 25(15):1960-6].

A phase 2/3 multicenter randomized trial was carried out to determine the efficacy and safety of a four drug combination chemotherapy regimen (FOLFIRINOX) (consisting of leucovorin calcium, fluorouracil, irinotecan hydrochloride and oxaliplatin) compared with gemcitabine as first-line therapy in patients with metastatic pancreatic cancer [Conroy T, et al., N Engl J Med. 2011 May 12; 364(19):1817-25]. Each of the drugs in this combination is approved by the FDA to treat cancer or conditions related to cancer. Patients who received the Folfirinox regimen lived approximately 4 months longer than patients treated with the current standard of care, gemcitabine (11.1 months compared with 6.8 months). The objective response rate was 31.6% in patients treated with Folfirinox versus 9.4% in patients treated with gemcitabine. Globally, Folfirinox was associated with a survival advantage but also with notable increased toxicity. Moreover, there exist a number of possible population biases to this study design, as well as possible confounding effects from the study design not being blinded. For example, the study design selected only those patients with a good performance status (ECOG status score of 0 or 1), and because of an increased risk of irinotecan-induced toxicity those patients with a high bilirubin level (typically manifested as jaundice and a common diagnostic sign in patients with pancreatic cancer in the head of the pancreas) were excluded. The implication of these treatment management restrictions and the greater toxicity of Folfirinox, as compared with gemcitabine, are to effectively preclude the use Folfirinox for a sizeable proportion of the global pancreatic cancer population, including those with the poorest prognosis who cannot tolerate this regimen. As such, Folfirinox is appropriate as a first-line option for patients with metastatic pancreatic cancer who are younger than 76 years and who have a good performance status, no cardiac ischemia, and normal or nearly normal bilirubin levels.

Masitinib In Vitro (Re)Sensitization of Pancreatic Cancer Cells to Gemcitabine

We previously discovered that the combination of masitinib and gemcitabine (Gemzar®, Eli Lilly and Company), a nucleoside analog, inhibits the growth of human pancreatic adenocarcinoma. Our in vitro and in vivo studies have shown that masitinib:

- Sensitized various cancer cell lines to gemcitabine [Thamm D H, et al. 2011 The Veterinary Journal, doi:10.1016/j.tvjl.2011.01.001].
- Sensitized gemcitabine-refractory pancreatic cancer cell lines [Humbert M, et al. (2010) PLoS ONE 5(3): e9430. doi:10.1371/journal.pone.0009430].
- Demonstrated antiproliferative activity of the masitinib plus gemcitabine combination in a Nog-SCID mouse model of human pancreatic cancer [Humbert M, et al. (2010) PLoS ONE 5(3): e9430. doi:10.1371/journal.pone.0009430].

These results supported a hypothesis that masitinib can enhance the antiproliferative activity of gemcitabine in vivo, possibly through chemosensitization. This theory was further reinforced by results from a human phase 2 study, in which patients with advanced pancreatic cancer who received a combination of masitinib (9 mg/kg/day) plus gemcitabine showed improved median time to progression compared with patients treated with gemcitabine alone for the overall population [Mitry E, et al, 2010. Cancer Chemotherapy and Pharmacology 66, 395].

AIMS OF THE INVENTION

The invention aims to solve the technical problem of providing an active ingredient for the treatment of cancer.

The invention also aims to solve the technical problem of providing an active ingredient that improves prior art methods for the treatment of cancer.

The invention aims to provide an efficient treatment for cancer at an appropriate dose, route of administration, and daily intake.

The invention aims to solve the technical problem of how to predict therapeutic response to said treatment in a given patient and therefore identify applicable patient subpopulations based upon these predictor factors.

One such predictor factor is based upon the clinical marker of pain intensity. Thus, the invention aims to solve the technical problem of providing an active ingredient that improves prior art methods for the treatment of cancer that is associated with pain or the requirement of opioid analgesics for the treatment of disease related pain.

Another predictor factor is based upon gene expression profiling via analysis of RNA expression in peripheral blood cell samples. Thus, the invention aims to solve the technical problem of providing an active ingredient that improves prior art methods for the treatment of cancer in patients harboring a specific gene or gene expression combinations (i.e. a genetic/transcriptomic fingerprint).

Despite attempts to develop combination chemotherapy regimens based upon gemcitabine, pancreatic cancer remains a chemoresistant and highly aggressive tumor. The treatment of advanced pancreatic cancer continues to be a major challenge in terms of chemotherapy-induced palliative effect on disease related symptoms and survival time. The Folfirinox regimen offers an alternative backbone to develop combination therapies but high toxicity will probably limit its use for the majority of patients. The continuing poor prognosis and lack of effective treatments for pancreatic cancer, and especially pancreatic cancer that is associated with pain, highlights an unmet medical need for more efficient treatment strategies that improve the clinical management of patients afflicted with pancreatic cancer without significantly increasing toxicity. Considering the limited life-expectancy of patients suffering from pancreatic cancer, improvements in either survival time or quality-of-life are highly meaningful goals. Moreover, a treatment capable of simultaneously improving both of these aspects would be of particular worth.

Thus, the invention aims to solve the technical problem of providing an active ingredient that improves prior art methods for the treatment of advanced adenocarcinoma pancreatic cancer.

The invention aims to solve the technical problem of providing an active ingredient that improves prior art methods for the treatment of advanced adenocarcinoma pancreatic cancer that is associated with pain or the requirement of opioid analgesics for the treatment of disease related pain.

The invention aims to solve the technical problem of providing an active ingredient that improves prior art methods for the treatment of advanced adenocarcinoma pancreatic cancer in patients harboring a specific gene or gene expression predictor factors (i.e. a genetic/transcriptomic fingerprint).

SUMMARY OF THE INVENTION

The present invention relates to a method for the treatment of cancer in a human patient, wherein said method comprises administering to a human patient in need thereof, a tyrosine kinase inhibitor, mast cell inhibitor or c-Kit inhibitor, especially masitinib or a pharmaceutically acceptable salt thereof, optionally combined with at least one antineoplastic agent.

By "antineoplastic agent", it is referred herein to a medicament for the treatment of cancers. For example, the compounds as depicted in: Actualite Pharmaceutiques no 302 (October 1992) on pages 38 to 39 and 41 to 43; or in the United States Food and Drug Administration (USFDA) list of approved drugs for oncology; or in the National Institute for Occupational Safety and Health (NIOSH) List of Antineoplastic and Other Hazardous Drugs in Healthcare Settings 2012 (DHHS Publication Number 2012-150); the content of which is incorporated by reference and is selected from, an alkylating agent, an antimitotic agent, an antimetabolic agent, an anti-topoisomerase I agent, a platinum analog, an antibiotic agent, a hormonal agent, an anti-angiogenic agent, a genotoxic agent, a cytotoxic agent, a biologic agent, or an additional tyrosine kinase inhibitor.

In particular, said antineoplastic agents include, but are not restricted to: abarelix, abiraterone acetate, aldesleukin, altretamine, anastrozole, arsenic trioxide, asparaginase, axitinib, azacitidine, bendamustine hydrochloride, bevacizumab, bexarotene, bicalutamide, leomycin, bortezomib, brentuximab vedotin, busulfan, cabazitaxel, Campath, Camptosar, capecitabine, carboplatin, carfilzomib, carmustine, cetuximab, chlorambucil, cisplatin, cladribine (2CDA), clofarabine, crizotinib, cyclophosphamide, cytarabine (ARA-C), cytosine arabinoside, dacarbazine, dactinomycin, dasatinib, daunorubicin, decitibine, degarelix, denileukin, docetaxel, doxorubicin, epirubicin, eribulin mesylate, erlotinib, estramustine phosphate, etoposide, everolimus, exemestane, floxuridine, fludarabine, fluoro-5-uracile (5 fluorouracil), fluorouridine-desoxyribose, flutamide, fulvestrant, gefitinib, gemcitabine, gemtuzumab ozogamicin, hydroxyurea, ibritumomab tiuxetan, idarubicin, ifosfamide, imatinib, ipilimumab, irinotecan, ixabepilone, lapatinib, letrozole, leucovorin, leuprolide acetate, lomustine, mechlorethamine, megestrol, melphalan, mercaptopurine, methotrexate, mitomycin, mitotane, mitoxantrone, nelarabine, nilotinib, nilutamide, Nolvadex, ofatumumab, oxaliplatin, paclitaxel, panitumumab, pazopanib, pegaspargase, peginterferon alfa-2b, pemetrexed, pentostatin, pertuzumab, plerixafor, pralatrexate, procarbazine, Proleukin, romidepsin, sapacitabine, sipuleucel-T, sorafenib, streptozocin, sunitinib, tamoxifen, temozolomide, temsirolimus, teniposide, testolactone, tezacitabine, thioguanine, thiotepa, topotecan, toremifene citrate, trastuzumab, triptorelin, troxacitabine, valrubicin, Valstar, vandetanib, vemurafenib, vinblastine, vincristine sulfate, vinorelbine, vismodegib, vorinostat, xeloda, ziv-aflibercept, zoledronic acid, FOLFOX (oxaliplatin+5 fluorouracil+folinic acid), FOLFIRI (irinotecan+5 fluorouracil+folinic acid), FOLFIRINOX (oxaliplatin+irinotecan+5 fluorouracil+folinic acid), and any combination of these antineoplastic agent.

By "treatment of cancer", it is referred herein as patients in need of treatment for cancer selected from, but not restricted to: acute lymphocytic leukemia (ALL), acute myelogenous leukemia (AML), adrenocortical carcinoma, anal cancer, B cell lymphoma, basal cell carcinoma, bile duct cancer, bladder cancer, bone cancer, brainstem glioma, brain tumor, breast cancer, cervical cancer, chronic lymphocytic leukemia (CLL), chronic myelogenous leukemia (CML), colorectal cancer (CRC), endometrial cancer, esophageal cancer, eye cancer, gallbladder cancer, gastric (stomach) cancer, gastrointestinal stromal tumor (GIST), glioblastoma multiforme (GBM), hairy cell leukemia, head and neck cancer, heart cancer, hepatocellular (liver) carcinoma (HCC), Hodgkin's lymphoma and non-Hodgkin's lymphomas, Kaposi sarcoma, laryngeal cancer, mastocytosis, melanoma, myelofibrosis, myelodysplastic syndrome (MDS), multiple myeloma, non-small-cell lung carcinoma (NSCLC), lung cancer (small cell), melanoma, nasopharyngeal carcinoma, neuroendocrine tumors, neuroblastoma, oral cancer, oropharyngeal cancer, ovarian cancer, pancreatic cancer, paranasal sinus and nasal cavity cancer, parathyroid cancer, penile cancer, pharyngeal cancer, pituitary adenoma, prostate cancer, rectal cancer, renal cell (kidney) carcinoma (RCC), salivary gland cancer, skin cancer (non-melanoma), small intestine cancer, small lymphocytic lymphoma (SSL), soft tissue sarcoma, squamous-cell carcinoma, T cell lymphoma, testicular cancer, throat cancer, thyroid cancer, triple negative breast cancer, urethral cancer, and uterine cancer.

In one embodiment, the present invention relates to the method as defined above wherein a tyrosine kinase inhibitor or a mast cell inhibitor is an inhibitor of kinase activity selected from the tyrosine kinases of: c-Kit, PDGFR, Lyn, Fyn, and DDR1.

In a particular embodiment, the tyrosine kinase inhibitor, mast cell inhibitor or c-Kit inhibitor is masitinib or a pharmaceutical acceptable salt thereof, in particular the mesilate salt.

By "predictor factor" or "biomarker", it is referred herein as a single characteristic or group of characteristics that is evaluated as an indicator of normal biologic processes, pathogenic processes, or pharmacologic responses to a therapeutic intervention. In relation to the present invention, the term "predictor factor" or "biomarker" refers also to the terms, predicative biomarker, prognostic biomarker, molecular marker, genetic marker, gene predictor set, genetic fingerprint, transcriptional fingerprint, genetic print, genetic signature, tumor marker, cancer marker, biological marker, biochemical marker, and biological indicator.

According to one embodiment, the present invention relates to the method as defined above, wherein said patient is initially selected for treatment based upon the predictor factor of pain intensity.

Thus, in one embodiment, the present invention relates to a method of treatment of cancer that is associated with pain or that requires administration of opioid analgesics for treatment of disease related pain, in human patient, wherein a tyrosine kinase inhibitor, mast cell inhibitor or c-Kit inhibitor, especially masitinib or a pharmaceutically acceptable salt thereof, is administered to patient in need thereof, optionally combined with at least one antineoplastic agent.

In another embodiment, the present invention relates to the method as defined above wherein said patient is afflicted by cancer that is associated with pain or that requires administration of opioid analgesics for treatment of disease related pain, and wherein 'pain' is defined as at least one reported occurrence of a non-zero pain intensity, as determined using an (appropriate) pain intensity assessment tool. It is implicit therefore, that according to the predictor factor of pain intensity, and in the absence of any other independent predictor factor, said treatment of patient afflicted by cancer that is not associated with pain or the requirement of opioid analgesics for the treatment of disease related pain is inadvisable.

In yet another embodiment, the present invention relates to the method as defined above wherein said patients is afflicted by cancer that is associated with pain or that requires administration of opioid analgesics for treatment of disease related pain, and wherein 'pain' is defined as above according to an (appropriate) pain intensity assessment tool, including but not limited to: the Verbal Rating Scale, the Visual Analogue Scale, the Numerical Rating Scale, the Behavior Rating Scale, the Picture Scale, the Box Scale, the Descriptor Differential nScale, the European Organization for Research and Treatment of Cancer quality-of-life questionnaire for pancreatic cancer (EORTC QLQ-PAN26), the Brief Pain Inventory (BPI), or the McGill Pain Questionnaire.

In one embodiment, the present invention relates to the method as defined above wherein said patient is afflicted by cancer that is associated with pain that requires administration of opioid analgesics for treatment of disease related pain, and wherein 'pain' is defined as at least one reported occurrence of a Visual Analogue Scale (VAS) pain intensity score of greater than 5 (e.g. VAS>5 mm as measured on a 100 mm scale, or 5%); or a VAS pain intensity score of greater than 10 (e.g. VAS>10 mm as measured on a 100 mm scale, or 10%); or even a VAS pain intensity score of greater than 20 (e.g. VAS>20 mm as measured on a 100 mm scale, or 20%).

In another embodiment, the present invention relates to the method as defined above wherein said patient is afflicted by cancer that is associated with pain or that requires administration of opioid analgesics for treatment of disease related pain, and wherein 'pain' is defined as at least one reported occurrence of an equivalent measure of said VAS pain intensity threshold, or at least one reported occurrence of moderate to intolerable pain according to a multidimensional or categorical pain assessment tool pain intensity rating.

In another embodiment the present invention relates to the method as defined above wherein said patient is afflicted by pancreatic cancer that is associated with pain or the requires the administration of opioid analgesics for treatment of disease related pain, and wherein pain is defined as at least one reported occurrence of a Visual Analogue Scale (VAS)

pain intensity score of greater than 20 (e.g. VAS>20 mm as measured on a 100 mm scale, or 20%).

According to one embodiment, the present invention relates to the method as defined above, wherein said patient is initially selected for treatment based upon gene expression predictor factors.

According to one embodiment, said gene expression predictor factors are derived from a blood sample of a patient, preferably on a whole peripheral blood sample of said patient. Peripheral blood is blood that circulates through the heart, arteries, capillaries and veins. The terms "whole blood" are used as opposed to a fraction of blood, obtained through separation of particular components of blood. An example of fraction is peripheral blood mononuclear cells. Hence, in one particular embodiment said gene expression predictor factors are derived from peripheral blood cell samples collected prior to treatment with said tyrosine kinase inhibitor, mast cell inhibitor or c-Kit inhibitor, especially masitinib or a pharmaceutically acceptable salt thereof.

Thus, in one embodiment, the present invention relates to a method of treatment of cancer, wherein a tyrosine kinase inhibitor, mast cell inhibitor or c-Kit inhibitor, especially masitinib or a pharmaceutically acceptable salt thereof, optionally combined with at least one antineoplastic agent, is administered to a patient in need thereof, wherein said patient has a peripheral blood up-regulation or down-regulation of at least one of the following genes: ACOX-1, TNFRSFS10B, RPS23, ABCC3, LYN, HIF1ALPHA, ABCC1, IGJ, UBE2H, or PARP-2, or homologous thereof.

The up-regulation or down-regulation of a given gene in a given patient is quantified in terms of a Delta Cycle Threshold (DCt) value, which is the gene expression level with respect to one or more reference genes. Such reference genes, or housekeeping genes, are characterized by a constant level of expression and therefore serve as an internal control. DCt values are inversely proportional to the level of gene expression; therefore, in the case of up-regulated genes a lower DCt value indicates a greater level of expression, whilst in the case of down-regulated genes a higher DCt value indicates a lower level of expression. It is understood that slight modifications to the defined Delta Cycle Threshold cut-offs are implicit, for example in the range of ±10% or even ±25%, reflecting the fact that the optimal threshold may be located in proximity to those cut-offs tested and that the patient population studied was only a representative cohort of the general cancer population.

The term "homologous" is defined as a polynucleotide sequence having a degree of identity of at least 80%, preferably 85%, more preferably 90%, and even more preferably 99% of the gene sequence (full length). The degree of identity refers to sequence identity between two sequences. Identity can be determined by comparing a position in each sequence which may be aligned for purposes of comparison. When an equivalent position in the compared sequences is occupied by the same base, then the molecules are identical at that position. Various alignment algorithms and/or programs may be used for determining the homology of two sequences, including FASTA and BLAST.

In another embodiment, the present invention relates to the method as defined above, wherein said patient has a concomitant up-regulation or down-regulation of at least two genes selected from: ACOX-1, TNFRSFS10B, RPS23, ABCC3, LYN, HIF1A, ABCC1, IGJ, UBE2H, and PARP-2. For example, dual-gene combinations include, but are not restricted to: the concomitant up-regulation of genes ACOX-1 and TNFRSF10B; the concomitant down-regulation of gene RPS23 and up-regulation of gene ACOX-1; the concomitant up-regulation of genes ABCC3 and LYN; the concomitant up-regulation of genes HIF1A and TNFRSF10B; the concomitant down-regulation of genes ABCC1 and IGJ; the concomitant down-regulation of genes UBE2H and PARP-2. Individually, these pairs of regulated genes are referred to as 'gene expression predictor factors', and collectively they are referred to as the 'genetic fingerprint' or 'transcriptional fingerprint'. Six pairs of regulated genes compose the 'genetic/transcriptional fingerprint'. Patients identified as having at least one gene expression predictor factor are considered to be harboring the 'genetic/transcriptional fingerprint'. It is implicit that in the absence of any other independent predictor factor, said treatment of any patient lacking said genetic/transcriptional fingerprint is inadvisable.

In one embodiment, the concomitant up-regulation of genes ACOX-1 and TNFRSF10B corresponds to patient Delta Cycle Threshold values of less than or equal to 3.81 for ACOX-1 and less than or equal to 7.63 for TNFRSF10B; more preferably to patient Delta Cycle Threshold values of less than or equal to 3.36 for ACOX-1 and less than or equal to 6.71 for TNFRSF10B; and even more preferably to patient Delta Cycle Threshold values of less than or equal to 3.05 for ACOX-1 and less than or equal to 6.1 for TNFRSF10B.

In one embodiment, the concomitant down-regulation of gene RPS23 and up-regulation of gene ACOX-1 corresponds to patient Delta Cycle Threshold values of greater than 0.26 for RPS23 and less than or equal to 3.81 for ACOX-1; more preferably to patient Delta Cycle Threshold values of greater than 0.32 for RPS23 and less than or equal to 3.36 for ACOX-1; and even more preferably to patient Delta Cycle Threshold values of greater than 0.35 for RPS23 and less than or equal to 3.05 for ACOX-1.

In one embodiment, the concomitant up-regulation of genes ABCC3 and LYN corresponds to patient Delta Cycle Threshold values of less than or equal to 5.38 for ABCC3 and less than or equal to 2.06 for LYN; more preferably to patient Delta Cycle Threshold values of less than or equal to 4.73 for ABCC3 and less than or equal to 1.82 for LYN; and even more preferably to patient Delta Cycle Threshold values of less than or equal to 4.3 for ABCC3 and less than or equal to 1.65 for LYN.

In one embodiment, the concomitant up-regulation of genes HIF1A and TNFRSF10B corresponds to patient Delta Cycle Threshold values of less than or equal to 4.94 for HIF1A and less than or equal to 7.06 for TNFRSF10B; more preferably to patient Delta Cycle Threshold values of less than or equal to 4.35 for HIF1A and less than or equal to 6.22 for TNFRSF10B; and even more preferably to patient Delta Cycle Threshold values of less than or equal to 3.95 for HIF1A and less than or equal to 5.65 for TNFRSF10B.

In one embodiment, the concomitant down-regulation of genes ABCC1 and IGJ corresponds to patient Delta Cycle Threshold values of greater than 2.63 for ABCC1 and less than or equal to 5.29 for IGJ; more preferably to patient Delta Cycle Threshold values of greater than 3.15 for ABCC1 and less than or equal to 6.35 for IGJ; and even more preferably to patient Delta Cycle Threshold values of greater than 3.5 for ABCC1 and less than or equal to 7.05 for IGJ.

In one embodiment, the concomitant down-regulation of genes UBE2H and PARP-2 corresponds to patient Delta Cycle Threshold values of greater than 2.78 for UBE2H and greater than 5.33 for PARP-2; more preferably to patient Delta Cycle Threshold values of greater than 3.33 for UBE2H and greater than 6.39 for PARP-2; and even more preferably to patient Delta Cycle Threshold values of greater than 3.7 for UBE2H and greater than 7.1 for PARP-2.

In another embodiment, the present invention relates to a method of treatment of cancer, wherein a tyrosine kinase inhibitor, mast cell inhibitor or c-Kit inhibitor, especially masitinib or a pharmaceutically acceptable salt thereof, optionally combined with at least one antineoplastic agent, is administered to a patient in need thereof, wherein said patient has a peripheral blood up-regulation of the gene ACOX-1, or homologous thereof.

In one embodiment, the up-regulation of gene ACOX-1 corresponds to patient Delta Cycle Threshold value of less than or equal to 3.81; more preferably of less than or equal to 3.36; and even more preferably of less than or equal to 3.05.

In one embodiment, the present invention relates to the method as defined above wherein masitinib is administered at a daily dose of 4.5 to 12.0 mg/kg/day, with the preferred embodiment for patients with cancer being a starting daily dose of 6.0 to 7.5 mg/kg/day.

In one embodiment, the present invention relates to the method as defined above wherein masitinib is dose escalated by increments of 1.5 mg/kg/day to reach a maximum of 12.0 mg/kg/day.

In one embodiment, the present invention relates to the method as defined above wherein said tyrosine kinase inhibitor, mast cell inhibitor or c-Kit inhibitor, especially masitinib or a pharmaceutically acceptable salt thereof, is administered orally.

In one embodiment, the present invention relates to the method as defined above wherein said tyrosine kinase inhibitor, mast cell inhibitor or c-Kit inhibitor, especially masitinib or a pharmaceutically acceptable salt thereof, is administered twice a day.

In one embodiment, the present invention relates to the method as defined above comprising a long term administration of an effective amount of said tyrosine kinase inhibitor, mast cell inhibitor or c-Kit inhibitor, especially masitinib or a pharmaceutically acceptable salt thereof, over more than 3 months.

In one embodiment, the present invention relates to the method as defined above, wherein said tyrosine kinase inhibitor, mast cell inhibitor or c-Kit inhibitor, especially masitinib or a pharmaceutically acceptable salt thereof, is administered in combination with the at least one antineoplastic agent, as a neoadjuvant, adjuvant, concomitant, or concurrent regimen.

In one embodiment, the present invention relates to the method as defined above wherein said tyrosine kinase inhibitor, mast cell inhibitor or c-Kit inhibitor, especially masitinib or a pharmaceutically acceptable salt thereof, and the at least one antineoplastic agent are administered separately, simultaneously or sequentially in time.

In one embodiment, the present invention relates to the method as defined above, for treatment of pancreatic cancer, wherein said tyrosine kinase inhibitor, mast cell inhibitor or c-Kit inhibitor is administered in combination with at least one antineoplastic agent selected from marketing medicaments for the treatment of cancer.

In one embodiment, the present invention relates to the method as defined above, wherein said patient suffers from unresectable adenocarcinoma pancreatic cancer or metastatic adenocarcinoma pancreatic cancer.

In one embodiment, the present invention relates to the method as defined above, wherein said pancreatic cancer patient is in need thereof, as defined by either the defined gene expression predictor factor or pain intensity predictor factor, and wherein said at least one antineoplastic agent is selected from: gemcitabine (Gemzar®; Lilly), erlotinib (Tarceva®; Roche), paclitaxel (Taxol®, Abraxane®; Bristol-Myers Squibb), Folfirinox, 5-fluorouracil (5-FU), capecitabine, cisplatin, oxaliplatin, irinotecan, leucovorin, and any combination of these antineoplastic agents.

In one embodiment, said at least one antineoplastic agent is gemcitabine.

In one preferred embodiment, the present invention relates to the method as defined above, wherein a product consisting of gemcitabine and masitinib or a pharmaceutically acceptable salt or hydrate thereof is used.

In one preferred embodiment, the present invention relates to the method as defined above, wherein masitinib is administered daily at a starting dose of 6.0±1.5 mg/kg/day with a maximum allowable dose of 9.0 mg/kg/day, and gemcitabine is administered at a weekly dose of 1000±250 mg/m$^2$ of patient surface area for up to seven consecutive weeks as a start, followed by a week off-treatment, followed by cycles of weekly dose of 1000±250 mg/m$^2$ for 3 weeks, every 28 days According to another embodiment, the present invention relates to a tyrosine kinase inhibitor, mast cell inhibitor or c-Kit inhibitor for use in a method for the treatment of a cancer as defined above, optionally in combination with at least one antineoplastic agent.

According to another embodiment, the present invention relates to a pharmaceutical composition or kit comprising a tyrosine kinase inhibitor, mast cell inhibitor or c-Kit inhibitor for use in a method for the treatment of a cancer as defined above, optionally in combination with at least one antineoplastic agent.

According to another embodiment, the present invention relates to the use of a tyrosine kinase inhibitor, mast cell inhibitor or c-Kit inhibitor for the preparation of a medicament, or a pharmaceutical composition, for the treatment of a cancer as defined above, optionally in combination with at least one antineoplastic agent.

According to another aspect, the invention relates to a therapeutic management plan for the treatment of cancer, in particular of pancreatic cancer in a human patient, wherein said management plan comprises the identification of treatable patients based upon the defined predictor factor of gene expression.

In one embodiment, the gene expression therapeutic management plan mentioned above is applied to patients with pancreatic cancer; wherein, if a patient harbors at least one gene expression predictor factor, and is therefore classified as belonging to the defined 'genetic/transcriptional fingerprint' subpopulation, then said patient is treated with at least one tyrosine kinase inhibitor, mast cell inhibitor or c-Kit inhibitor, and especially masitinib, optionally in combination with at least one nucleoside analogue, in particular a cytidine analogue, and especially gemcitabine. If a patient does not harbor at least one gene expression predictor factor, and is therefore classified as belonging to the defined 'non genetic/transcriptional fingerprint' subpopulation, then said patient is treated with at least one nucleoside analogue, in particular a cytidine analogue, and especially gemcitabine.

In another embodiment, the gene expression therapeutic management plan mentioned above is applied to patients with cancer other than pancreatic cancer; wherein, if a patient harbors at least one gene expression predictor factor then said patient is treated with at least one tyrosine kinase inhibitor, mast cell inhibitor or c-Kit inhibitor, and especially masitinib, optionally in combination with at least one antineoplastic agent. If a patient does not harbor at least one gene expression predictor factor then said patient is treated with at least one antineoplastic agent.

According to another aspect, the invention relates to a therapeutic management plan for the treatment of cancer, in particular of pancreatic cancer in a human patient, based upon the defined predictor factor of pain intensity, wherein said management plan comprises:
 a) determining if said patient is afflicted by cancer that is associated with pain or requires administration of at least one opioid analgesic for treatment of disease related pain, with pain intensity preferably defined as a reported occurrence of a Visual Analogue Scale (VAS) score higher than 5 mm on a 100 mm scale; and optionally
 b) determining if said disease related pain is defined as a reported occurrence of a Visual Analogue Scale (VAS) pain intensity score higher than a predetermined value for said cancer on a 100 mm scale, and in particular for pancreatic cancer a Visual Analogue Scale (VAS) pain intensity score higher than 20 mm on a 100 mm scale.

In one embodiment said predetermined value for said disease related pain is 20 mm on a 100 mm scale.

In one embodiment, the pain intensity therapeutic management plan mentioned above is applied to patients with pancreatic cancer; wherein, if the result of step (a) is negative, then the patient is treated with at least one nucleoside analogue, in particular a cytidine analogue, and especially gemcitabine. If the result of step (a) is positive and the result of step (b) is negative, then the patient is treated with at least one drug targeting epidermal growth factor receptor (EGFR), and particularly erlotinib, in combination with at least one nucleoside analogue, in particular a cytidine analogue, and especially gemcitabine; or with at least one mitotic inhibitor, and particularly paclitaxel, in combination with at least one nucleoside analogue, in particular a cytidine analogue, and especially gemcitabine; or with at least one combination of drugs including fluorouracil, leucovorin, irinotecan, or oxaliplatin, and particularly Folfirinox. If the result of step (a) is positive and the result of step (b) is positive, then the patient is treated with at least one tyrosine kinase inhibitor, mast cell inhibitor or c-Kit inhibitor, and especially masitinib, optionally in combination with at least one nucleoside analogue, in particular a cytidine analogue, and especially gemcitabine.

In another embodiment, the pain intensity therapeutic management plan mentioned above is applied to patients with cancer other than pancreatic cancer; wherein, if the result of step (a) is negative, then the patient is treated with at least one antineoplastic agent. If the result of step (a) is positive and the result of step (b) is negative, then the patient is treated with at least one antineoplastic agent. If the result of step (a) is positive and the result of step (b) is positive, then the patient is treated with at least one tyrosine kinase inhibitor, mast cell inhibitor or c-Kit inhibitor, and especially masitinib, optionally in combination with at least one antineoplastic agent.

According to another aspect, the invention relates to a global therapeutic management plan for the treatment of cancer, in particular of pancreatic cancer in a human patient, wherein said management plan comprises the identification of treatable patients based upon sequential application of the gene expression therapeutic management plan and pain intensity therapeutic management plan. Thus, in the pain intensity therapeutic management plan mentioned above, step (a) can be preceded by step (a') consisting in the identification of patients that harbor at least one gene expression predictor factor, as described above.

In one embodiment, the global therapeutic management plan mentioned above is applied to pancreatic cancer, wherein: if the result of step (a') is positive, then the patient is treated with at least one tyrosine kinase inhibitor, mast cell inhibitor or c-Kit inhibitor, and especially masitinib, optionally in combination with at least one nucleoside analogue, in particular a cytidine analogue, and especially gemcitabine; if the result of step (a') is negative, then step (a) of the pain intensity therapeutic management plan for pancreatic cancer is invoked. Specifically, said management plan comprises:
 a) determining if said patient is afflicted by pancreatic cancer that is associated with pain or requires administration of at least one opioid analgesic for treatment of disease related pain, with pain intensity preferably defined as a reported occurrence of a Visual Analogue Scale (VAS) score higher than 5 mm on a 100 mm scale; and optionally
 b) determining if said disease related pain is defined as a reported occurrence of a Visual Analogue Scale (VAS) pain intensity score higher than 20 mm on a 100 mm scale.

If the result of step (a) is negative, then the patient is treated with at least one nucleoside analogue, in particular a cytidine analogue, and especially gemcitabine.

If the result of step (a) is positive and the result of step (b) is negative, then the patient is treated with at least one drug targeting epidermal growth factor receptor (EGFR), and particularly erlotinib, in combination with at least one nucleoside analogue, in particular a cytidine analogue, and especially gemcitabine; or with at least one mitotic inhibitor, and particularly paclitaxel, in combination with at least one nucleoside analogue, in particular a cytidine analogue, and especially gemcitabine; or with at least one combination of drugs including fluorouracil, leucovorin, irinotecan, or oxaliplatin, and particularly Folfirinox.

If the result of step (a) is positive and the result of step (b) is positive, then the patient is treated with at least one tyrosine kinase inhibitor, mast cell inhibitor or c-Kit inhibitor, and especially masitinib, optionally in combination with at least one nucleoside analogue, in particular a cytidine analogue, and especially gemcitabine.

In another embodiment, the global therapeutic management plan mentioned above is applied to patients with cancer other than pancreatic cancer; wherein, if the result of step (a') is positive, then the patient is treated with at least one tyrosine kinase inhibitor, mast cell inhibitor or c-Kit inhibitor, and especially masitinib, optionally in combination with at least one antineoplastic agent. If the result of step (a') is negative, then step (a) of the pain intensity therapeutic management plan for cancer is invoked. Specifically, said management plan comprises:
 a) determining if said patient is afflicted by cancer that is associated with pain or requires administration of at least one opioid analgesic for treatment of disease related pain, with pain intensity preferably defined as a reported occurrence of a Visual Analogue Scale (VAS) score higher than 5 mm on a 100 mm scale; and optionally
 b) determining if said disease related pain is defined as a reported occurrence of a Visual Analogue Scale (VAS) pain intensity score higher than a predetermined value for said cancer on a 100 mm scale.

If the result of step (a) is negative, then the patient is treated with at least one antineoplastic agent.

If the result of step (a) is positive and the result of step (b) is negative, then the patient is treated with at least one antineoplastic agent.

If the result of step (a) is positive and the result of step (b) is positive, then the patient is treated with at least one tyrosine kinase inhibitor, mast cell inhibitor or c-Kit inhibitor, and especially masitinib, optionally in combination with at least one antineoplastic agent.

Figure 3:
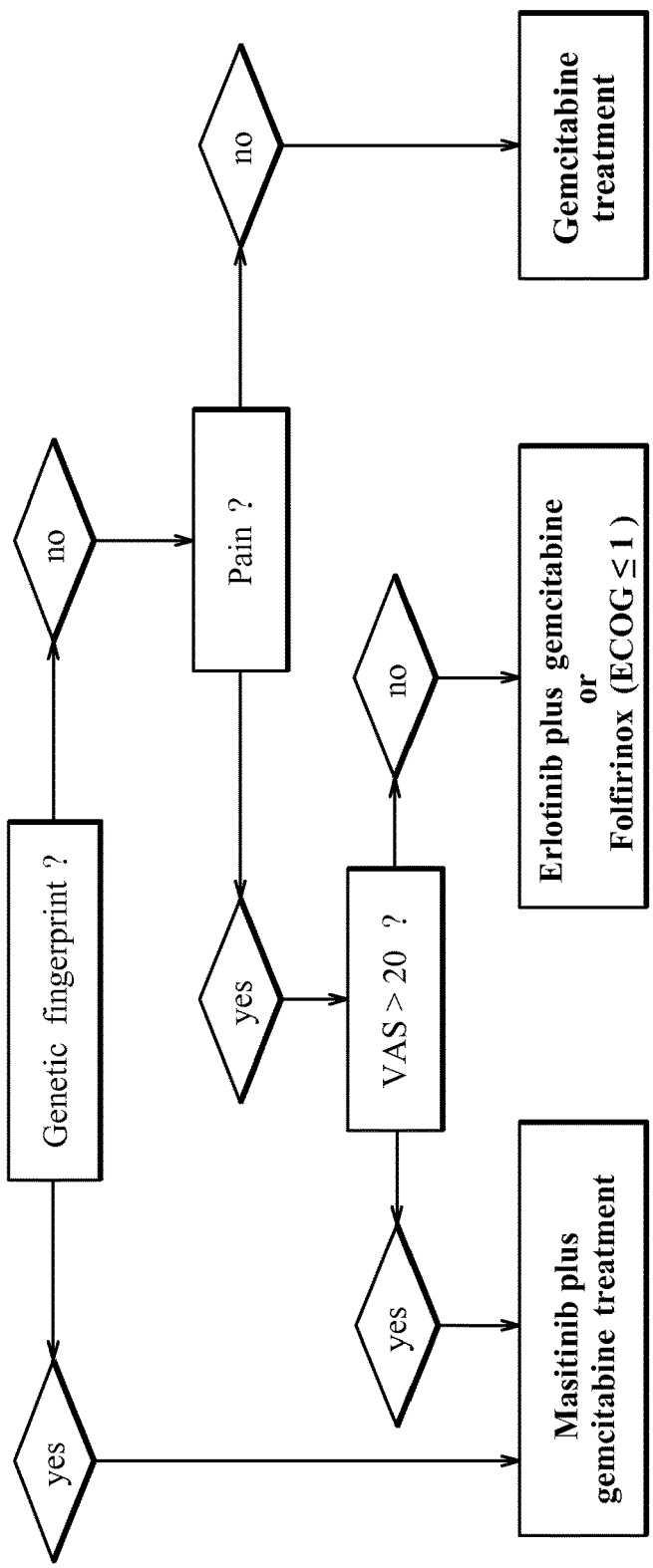

FIG. 3 illustrates the treatment management plans associated with the individual predictor factors of pain intensity and gene expression for pancreatic cancer patients, as well as a global treatment management plan that takes both predictor factors into consideration.

DESCRIPTION OF THE INVENTION

Tyrosine kinases are receptor type or non-receptor type proteins, which transfer the terminal phosphate of ATP to tyrosine residues of proteins thereby activating or inactivating signal transduction pathways. These proteins are known to be involved in many cellular mechanisms, which in case of disruption, lead to disorders such as abnormal cell proliferation and migration as well as inflammation. A tyrosine kinase inhibitor is a drug that inhibits tyrosine kinases, thereby interfering with signaling processes within cells. Blocking such processes can stop the cell growing and dividing.

In one embodiment, the tyrosine kinase inhibitor of the invention has the following formula [A]:

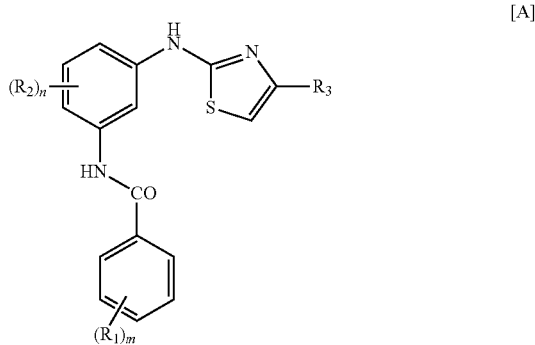

[A]

wherein $R_1$ and $R_2$, are selected independently from hydrogen, halogen, a linear or branched alkyl, cycloalkyl group containing from 1 to 10 carbon atoms, trifluoromethyl, alkoxy, cyano, dialkylamino, and a solubilizing group,
m is 0-5 and n is 0-4;
the group $R_3$ is one of the following:
(i) an aryl group such as phenyl or a substituted variant thereof bearing any combination, at any one ring position, of one or more substituents such as halogen, alkyl groups containing from 1 to 10 carbon atoms, trifluoromethyl, cyano and alkoxy;
(ii) a heteroaryl group such as 2, 3, or 4-pyridyl group, which may additionally bear any combination of one or more substituents such as halogen, alkyl groups containing from 1 to 10 carbon atoms, trifluoromethyl and alkoxy;
(iii) a five-membered ring aromatic heterocyclic group such as for example 2-thienyl, 3-thienyl, 2-thiazolyl, 4-thiazolyl, 5-thiazolyl, which may additionally bear any combination of one or more substituents such as halogen, an alkyl group containing from 1 to 10 carbon atoms, trifluoromethyl, and alkoxy;
or a pharmaceutically acceptable salt or solvate thereof.

Tyrosine kinase inhibitors of formula [A] can preferably be used as c-Kit inhibitors.

Unless otherwise specified, the below terms used herein are defined as follows:

As used herein, the term an "aryl group" means a monocyclic or polycyclic-aromatic radical comprising carbon and hydrogen atoms. Examples of suitable aryl groups include, but are not limited to, phenyl, tolyl, anthracenyl, fluorenyl, indenyl, azulenyl, and naphthyl, as well as benzo-fused carbocyclic moieties such as 5,6,7,8-tetrahydronaphthyl. An aryl group can be unsubstituted or substituted with one or more substituents. In one embodiment, the aryl group is a monocyclic ring, wherein the ring comprises 6 carbon atoms, referred to herein as "$(C_6)$aryl".

As used herein, the term "alkyl group" means a saturated straight chain or branched non-cyclic hydrocarbon having from 1 to 10 carbon atoms. Representative saturated straight chain alkyls include methyl, ethyl, n-propyl, n-butyl, n-pentyl, n-hexyl, n-heptyl, n-octyl, n-nonyl and n-decyl; while saturated branched alkyls include isopropyl, sec-butyl, isobutyl, tert-butyl, isopentyl, 2-methylbutyl, 3-methylbutyl, 2-methylpentyl, 3-methylpentyl, 4-methylpentyl, 2-methylhexyl, 3-methylhexyl, 4-methylhexyl, 5-methylhexyl, 2,3-dimethylbutyl, 2,3-dimethylpentyl, 2,4-dimethylpentyl, 2,3-dimethylhexyl, 2,4-dimethylhexyl, 2,5-dimethylhexyl, 2,2-dimethylpentyl, 2,2-dimethylhexyl, 3,3-dimtheylpentyl, 3,3-dimethylhexyl, 4,4-dimethylhexyl, 2-ethylpentyl, 3-ethylpentyl, 2-ethylhexyl, 3-ethylhexyl, 4-ethylhexyl, 2-methyl-2-ethylpentyl, 2-methyl-3-ethylpentyl, 2-methyl-4-ethylpentyl, 2-methyl-2-ethylhexyl, 2-methyl-3-ethylhexyl, 2-methyl-4-ethylhexyl, 2,2-diethylpentyl, 3,3-diethylhexyl, 2,2-diethylhexyl, 3,3-diethylhexyl and the like. Alkyl groups included in compounds of this invention may be optionally substituted with one or more substituents.

As used herein, the term "alkoxy" refers to an alkyl group which is attached to another moiety by an oxygen atom. Examples of alkoxy groups include methoxy, isopropoxy, ethoxy, tert-butoxy, and the like. Alkoxy groups may be optionally substituted with one or more substituents.

As used herein, the term "heteroaryl" or like terms means a monocyclic or polycyclic heteroaromatic ring comprising carbon atom ring members and one or more heteroatom ring members (such as, for example, oxygen, sulfur or nitrogen). Typically, a heteroaryl group has from 1 to about 5 heteroatom ring members and from 1 to about 14 carbon atom ring members. Representative heteroaryl groups include pyridyl, 1-oxo-pyridyl, furanyl, benzo[1,3]dioxolyl, benzo[1,4]dioxinyl, thienyl, pyrrolyl, oxazolyl, imidazolyl, thiazolyl, isoxazolyl, quinolinyl, pyrazolyl, isothiazolyl, pyridazinyl, pyrimidinyl, pyrazinyl, triazinyl, triazolyl, thiadiazolyl, isoquinolinyl, indazolyl, benzoxazolyl, benzofuryl, indolizinyl, imidazopyridyl, tetrazolyl, benzimidazolyl, benzothiazolyl, benzothiadiazolyl, benzoxadiazolyl, indolyl, tetrahydroindolyl, azaindolyl, imidazopyridyl, quinazolinyl, purinyl, pyrrolo[2,3]pyrimidinyl, pyrazolo[3,4]pyrimidinyl, imidazo[1,2-a]pyridyl, and benzo(b)thienyl. A heteroatom may be substituted with a protecting group known to those of ordinary skill in the art, for example, the hydrogen on a nitrogen may be substituted with a tert-butoxycarbonyl group. Heteroaryl groups may be optionally substituted with one or more substituents. In addition, nitrogen or sulfur heteroatom ring members may be oxidized. In one embodiment, the heteroaromatic ring is selected from 5-8 membered monocyclic heteroaryl rings. The point of attachment of a heteroaromatic or heteroaryl ring to another group may be at either a carbon atom or a heteroatom of the heteroaromatic or heteroaryl rings.

The term "heterocycle" as used herein, refers collectively to heterocycloalkyl groups and heteroaryl groups.

As used herein, the term "heterocycloalkyl" means a monocyclic or polycyclic group having at least one heteroatom selected from O, N or S, and which has 2-11 carbon atoms, which may be saturated or unsaturated, but is not aromatic. Examples of heterocycloalkyl groups include (but are not limited to): piperidinyl, piperazinyl, 2-oxopiperazinyl, 2-oxopiperidinyl, 2-oxopyrrolidinyl, 4-piperidonyl, pyrrolidinyl, hydantoinyl, valerolactamyl, oxiranyl, oxetanyl, tetrahydropyranyl, tetrahydrothiopyranyl, tetrahydropyrindinyl, tetrahydropyrimidinyl, tetrahydrothiopyranyl sulfone, tetrahydrothiopyranyl sulfoxide, morpholinyl, thiomorpholinyl, thiomorpholinyl sulfoxide, thiomorpholinyl sulfone, 1,3-dioxolane, tetrahydrofuranyl, dihydrofuranyl-2-one, tetrahydrothienyl, and tetrahydro-1,1-dioxothienyl. Typically, monocyclic heterocycloalkyl groups have 3 to 7 members. Preferred 3 to 7 membered monocyclic heterocycloalkyl groups are those having 5 or 6 ring atoms. A heteroatom may be substituted with a protecting group known to those of ordinary skill in the art, for example, the hydrogen on a nitrogen may be substituted with a tert-butoxycarbonyl group. Furthermore, heterocycloalkyl groups may be optionally substituted with one or more substituents. In addition, the point of attachment of a heterocyclic ring to another group may be at either a carbon atom or a heteroatom of a heterocyclic ring. Only stable isomers of such substituted heterocyclic groups are contemplated in this definition.

As used herein the term "substituent" or "substituted" means that a hydrogen radical on a compound or group is replaced with any desired group that is substantially stable to reaction conditions in an unprotected form or when protected using a protecting group. Examples of preferred substituents are those found in the exemplary compounds and embodiments disclosed herein, as well as halogen (chloro, iodo, bromo, or fluoro); alkyl; alkenyl; alkynyl; hydroxy; alkoxy; nitro; thiol; thioether; imine; cyano; amido; phosphonato; phosphine; carboxyl; thiocarbonyl; sulfonyl; sulfonamide; ketone; aldehyde; ester; oxygen (—O); haloalkyl (e.g., trifluoromethyl); cycloalkyl, which may be monocyclic or fused or non-fused polycyclic (e.g., cyclopropyl, cyclobutyl, cyclopentyl, or cyclohexyl), or a heterocycloalkyl, which may be monocyclic or fused or non-fused polycyclic (e.g., pyrrolidinyl, piperidinyl, piperazinyl, morpholinyl, or thiazinyl), monocyclic or fused or non-fused polycyclic aryl or heteroaryl (e.g., phenyl, naphthyl, pyrrolyl, indolyl, furanyl, thiophenyl, imidazolyl, oxazolyl, isoxazolyl, thiazolyl, triazolyl, tetrazolyl, pyrazolyl, pyridyl, quinolinyl, isoquinolinyl, acridinyl, pyrazinyl, pyridazinyl, pyrimidinyl, benzimidazolyl, benzothiophenyl, or benzofuranyl); amino (primary, secondary, or tertiary); $CO_2CH_3$; $CONH_2$; $OCH_2CONH_2$; $NH_2$; $SO_2NH_2$; $OCHF_2$; $CF_3$; $OCF_3$; and such moieties may also be optionally substituted by a fused-ring structure or bridge, for example —$OCH_2O$—. These substituents may optionally be further substituted with a substituent selected from such groups. In certain embodiments, the term "substituent" or the adjective "substituted" refers to a substituent selected from the group consisting of an alkyl, an alkenyl, an alkynyl, an cycloalkyl, an cycloalkenyl, a heterocycloalkyl, an aryl, a heteroaryl, an aralkyl, a heteraralkyl, a haloalkyl, —C(O)$NR_{11}R_{12}$, —$NR_{13}C(O)R_{14}$, a halo, —$OR_{13}$, cyano, nitro, a haloalkoxy, —C(O)$R_{13}$, —$NR_{11}R_{12}$, —$SR_{13}$, —C(O)$OR_{13}$, —OC(O)$R_{13}$, —$NR_{13}C(O)NR_{11}R_{12}$, —OC(O)$NR_{11}R_{12}$, —$NR_{13}C(O)OR_{14}$, —S(O)$rR_{13}$, —$NR_{13}S(O)rR_{14}$, —OS(O)$rR_{14}$, S(O)$rNR_{11}R_{12}$, —O, —S, and —N—$R_{13}$, wherein r is 1 or 2; $R_{11}$ and $R_{12}$, for each occurrence are, independently, H, an optionally substituted alkyl, an optionally substituted alkenyl, an optionally substituted alkynyl, an optionally substituted cycloalkyl, an optionally substituted cycloalkenyl, an optionally substituted heterocycloalkyl, an optionally substituted aryl, an optionally substituted heteroaryl, an optionally substituted aralkyl, or an optionally substituted heteraralkyl; or $R_{11}$ and $R_{12}$ taken together with the nitrogen to which they are attached is optionally substituted heterocycloalkyl or optionally substituted heteroaryl; and $R_{13}$ and $R_{14}$ for each occurrence are, independently, H, an optionally substituted alkyl, an optionally substituted alkenyl, an optionally substituted alkynyl, an optionally substituted cycloalkyl, an optionally substituted cycloalkenyl, an optionally substituted heterocycloalkyl, an optionally substituted aryl, an optionally substituted heteroaryl, an optionally substituted aralkyl, or an optionally substituted heteraralkyl.

In certain embodiments, the term "substituent" or the adjective "substituted" refers to a solubilizing group.

The term "solubilizing group" means any group which can be substantially ionized and that enables the compound to be soluble in a desired solvent, such as, for example, water or water-containing solvent. Furthermore, the solubilizing group can be one that increases the compound or complex's lipophilicity. Typically, the solubilizing group is selected from alkyl group substituted with one or more heteroatoms such as N, O, S, each optionally substituted with alkyl group substituted independently with alkoxy, amino, alkylamino, dialkylamino, carboxyl, cyano, or substituted with cycloheteroalkyl or heteroaryl, or a phosphate, or a sulfate, or a carboxylic acid. For example, by "solubilizing group" it is referred herein to one of the following:

an alkyl, cycloalkyl, aryl, heretoaryl group comprising either at least one nitrogen or oxygen heteroatom or which group is substituted by at least one amino group or oxo group;

an amino group which may be a saturated cyclic amino group which may be substituted by a group consisting of alkyl, alkoxycarbonyl, halogen, haloalkyl, hydroxyalkyl, amino, monoalkylamino, dialkylamino, carbamoyl, monoalkylcarbamoyl and dialkylcarbamoyl;

one of the structures a) to i) shown below, wherein the wavy line and the arrow line correspond to the point of attachment to core structure of Formula [A]:

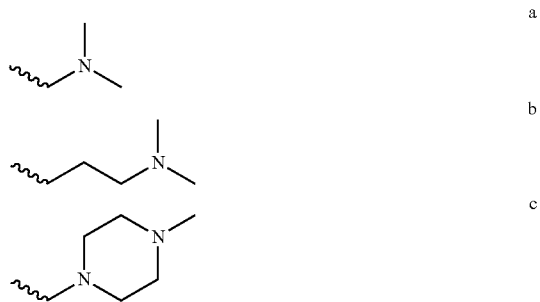

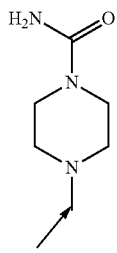

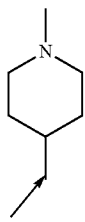

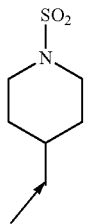

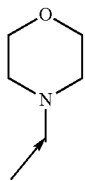

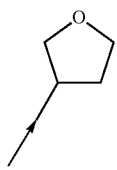

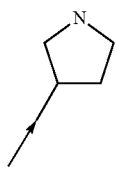

The term "cycloalkyl" means a saturated cyclic alkyl radical having from 3 to 10 carbon atoms. Representative cycloalkyls include cyclopropyl, 1-methylcyclopropyl, cyclobutyl, cyclopentyl, cyclohexyl, cycloheptyl, cyclooctyl, cyclononyl, and cyclodecyl. Cycloalkyl groups can be optionally substituted with one or more substituents.

The term "halogen" means —F, —Cl, —Br or —I.

In a particular embodiment the tyrosine kinase inhibitor of the invention has general formula [B],

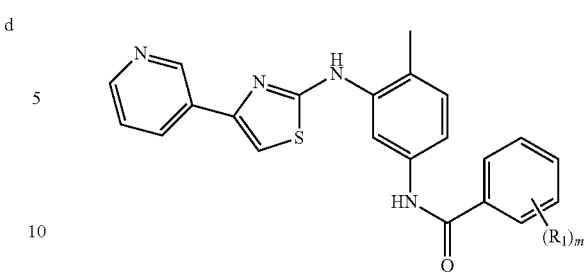

wherein:

$R_1$ is selected independently from hydrogen, halogen, a linear or branched alkyl, cycloalkyl group containing from 1 to 10 carbon atoms, trifluoromethyl, alkoxy, amino, alkylamino, dialkylamino, solubilizing group, and m is 0-5.

In one embodiment, the tyrosine kinase inhibitor, mast cell inhibitor or c-Kit inhibitor is masitinib or a pharmaceutically acceptable salt thereof, more preferably masitinib mesilate.

Masitinib is a c-Kit/PDGFR inhibitor with a potent anti mast cell action.

New potent and selective c-Kit, platelet derived growth factor receptor (PDGFR) inhibitors are 2-(3-aminoaryl) amino-4-aryl-thiazoles described in AB Science's PCT application WO 2004/014903.

Masitinib is a small molecule drug, selectively inhibiting specific tyrosine kinases such as c-Kit, PDGFR, Lyn, Fyn, and DDR1 without inhibiting, at therapeutic doses, kinases associated with known toxicities (i.e. those tyrosine kinases or tyrosine kinase receptors attributed to possible tyrosine kinase inhibitor cardiac toxicity, including ABL, KDR and Src) [Dubreuil et al., 2009, PLoS ONE 2009. 4(9):e7258; Davis et al., Nat Biotechnol 2011, 29(11): 1046-51]. The chemical name for masitinib is 4-(4-methylpiperazin-1-ylmethyl)-N-[4-methyl-3-(4-pyridin-3ylthiazol-2-ylamino) phenyl]benzamide—CAS number 790299-79-5, and the structure is shown below. Masitinib was first described in U.S. Pat. No. 7,423,055 and EP1525200B1. A detailed procedure for the synthesis of masitinib mesilate is given in WO2008/098949.

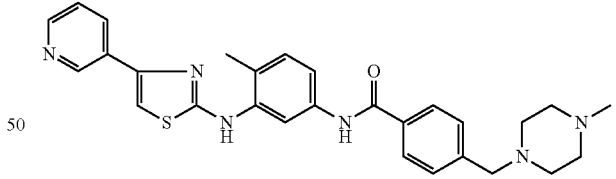

Masitinib's main kinase target is c-Kit, for which it has been shown to exert a strong inhibitory effect on wild-type and juxtamembrane-mutated c-Kit receptors, resulting in cell cycle arrest and apoptosis of cell lines dependent on c-Kit signaling [Dubreuil et al., 2009, PLoS ONE, 4(9): e7258]. In vitro, masitinib demonstrated high activity and selectivity against c-Kit, inhibiting recombinant human wild-type c-Kit with an half inhibitory concentration (1050) of 200±40 nM and blocking stem cell factor-induced proliferation and c-Kit tyrosine phosphorylation with an IC50 of 150±80 nM in Ba/F3 cells expressing human or mouse wild-type c-Kit. In addition to its anti-proliferative properties, masitinib can also regulate the activation of mast cells through its targeting of Lyn and Fyn, key components of the transduction pathway leading to IgE induced degranulation [(Gilfillan et al., 2006, Nat Rev Immunol, 6:218-230); (Gilfillan et al., 2009, Immunological Reviews, 228:149-169)]. This can be observed in the inhibition of FcεRI-mediated degranulation of human cord blood mast cells [Dubreuil et al., 2009, PLoS ONE; 4(9):e7258]. Masitinib is also an inhibitor of PDGFR a and β receptors. Recombinant assays show that masitinib inhibits the in vitro protein kinase activity of PDGFR-α and β with IC50 values of 540±60 nM and 800±120 nM. In Ba/F3 cells expressing PDGFR-α, masitinib inhibited PDGF-BB-stimulated proliferation and PDGFR-α tyrosine phosphorylation with an 1050 of 300±5 nM. Furthermore, masitinib strongly interacts with the discoidin domain receptor family member 1 (DDR1) kinase, leading to a pronounced inhibition of DDR1 autophosphorylation. Although the physiological functions of DDR1 are not fully understood, DDR1 signaling seems to be involved in cell interactions with the extracellular matrix, and to control adhesion and cell motility, which are both essential characteristics of cancer cells. The deregulation of these capabilities is associated with tumor progression and poor prognosis in a number of human cancers. Masitinib has been shown to strongly bond to the DDR1 receptor and inhibit its activity [Davis et al., Nat Biotechnol 2011, 29(11): 1046-51]. Masitinib could therefore slow down the homing and colonization of tumor cells.

The present invention relates to a method for the treatment of cancer in a human patient, wherein said method comprises administering to a human patient in need thereof, a tyrosine kinase inhibitor, mast cell inhibitor or c-Kit inhibitor, especially masitinib or a pharmaceutically acceptable salt thereof, optionally combined with at least one antineoplastic agent.

In relation to the present invention, the term "treatment" (and its various grammatical forms) refers to preventing, curing, reversing, attenuating, alleviating, minimizing, suppressing or halting the deleterious effects of a disease state, disease progression, disease causative agent (e.g., bacteria or viruses) or other abnormal condition. For example, treatment may involve alleviating a symptom (i.e., not necessary all symptoms) of a disease or attenuating the progression of a disease.

The inventors have surprisingly shown that the combination of masitinib plus gemcitabine provides therapeutic benefit to a highly distinct subpopulation of pancreatic cancer patients with pain intensity serving as an independent predictor factor.

A randomized placebo-controlled phase 3 study (AB07012) was conducted based on the aforementioned in vitro and preliminary in vivo data to determine the efficacy and safety of a masitinib in combination with gemcitabine compared with gemcitabine alone as first-line therapy in patients with advanced/metastatic pancreatic cancer (see Example 1). It was strongly predicted that the principal mechanism of action responsible for any improvement in masitinib treated patient survival would be a masitinib-induced sensitization of pancreatic cancer cells to gemcitabine. It follows therefore, that the patient population to benefit from the masitinib plus gemcitabine combination would closely mirror that for gemcitabine treatment, regardless of subpopulation variables such as patient performance status, age, or tumor localization etc.; i.e. all patients with locally advanced (unresectable Stage II or Stage III) or metastatic (Stage IV) adenocarcinoma of the pancreas.

Results from study AB07012 revealed that in the modified intent to treat (mITT) population there was no survival advantage in patients treated with the masitinib plus gemcitabine combination compared with patients receiving gemcitabine plus placebo, i.e. gemcitabine as a single agent (see Example 1). Unexpectedly, secondary exploratory analyses on overall survival, stratified according to pain intensity, revealed that the combination of masitinib plus gemcitabine had improved survival compared with gemcitabine as a single agent, in a subpopulation of patients having pancreatic cancer that was associated with pain or the requirement of opioid analgesics for the treatment of disease related pain. These data also showed, without precedent, that pain intensity was the predominant prognostic factor for overall survival in pancreatic cancer patients receiving gemcitabine as a single agent (the current standard of treatment). Specifically, data revealed that for patients receiving gemcitabine as a single agent (i.e. the placebo plus gemcitabine treatment arm), there was a difference in survival time of 10.0 months between those patients presenting with disease related pain at baseline and those without disease related pain or the requirement of opioid analgesics for treatment of disease related pain (median OS of 5.4 versus 15.4 months, respectively) (see Example 1). Moreover, by following the evolution of the hazard ratio of overall survival according to pain intensity it was revealed that the probability of survival improved with increasing pain intensity for patients receiving masitinib plus gemcitabine as compared with patients receiving placebo plus gemcitabine. This relationship is shown in the curve of hazard ratio for death, defined as the probability of death under masitinib plus gemcitabine over the probability of death under placebo plus gemcitabine, versus the VAS score (FIG. 1). The hazard ratio for death tended to decrease with increasing VAS score until reaching a plateau (or horizontal asymptote) from the VAS score of 20 mm. At a VAS score of 55 mm, the number of patients was dramatically reduced and hazard ratio was therefore not appropriate for further analysis. These results supported the choice to divide the overall population into three VAS pain intensity subpopulations: VAS [0; 5], VAS [5; 20], and VAS>20 (see Example 1).

These findings are without precedent and considered as important because the predictive therapeutic significance of pain intensity in cancer patients was previously unknown. Indeed, a previous study evaluating erlobinib (Tarceva®, an inhibitor of the EGFR growth factor) plus gemcitabine in pancreatic cancer showed that for the equivalent 'pain' subpopulation there was no survival benefit [Moore M J, et al., J Clin Oncol. 2007 May 20; 25(15):1960-6]. This is in direct contrast to the findings for the masitinib plus gemcitabine combination. Data also indicated that the mechanisms of action responsible for the observed therapeutic benefits of the combination therapy have a relatively slow on-set, therefore necessitating a minimum exposure time for optimal therapeutic benefits to be attained.

This outcome could not have been predicted from knowledge acquired prior to study AB07012 or from or the general scientific literature. Moreover, these findings are highly contradictory to our initial understanding of the primary mechanism of action for the masitinib plus gemcitabine combination in pancreatic cancer, i.e. a masitinib-induced sensitization of pancreatic cancer cells to gemcitabine [Humbert M, et al. (2010) PLoS ONE 5(3): e9430. doi: 10.1371/journal.pone.0009430]. These data effectively show that for the in vivo clinical setting of pancreatic cancer treatment, sensitization of pancreatic cancer cells cannot be the primary mechanism of masitinib's action because: (i) there should be no heterogeneity in response according to patients' disease related pain intensity; and (ii) such an effect would be expected have a relatively rapid on-set and therefore manifest itself in an improved progression free survival, which was not the case.

Data from study AB07012 (see Example 1) have led to the surprising discovery that a highly distinct subpopulation of pancreatic cancer patients respond to the masitinib plus gemcitabine combination, with a distinction being made according to the degree (intensity) of disease related pain. Also that contrary to expectations, the onset of this response in efficacy was relatively slow as compared with surrogate measures of disease progression; its effects manifested in the long term survival (i.e. overall survival) rather than the short term time to disease progression (i.e. progression free survival). All these findings point towards secondary mechanisms of action being responsible for the observed therapeutic benefits (referred to as secondary because they do not act directly on the cancer cells themselves but on cells and signaling pathways that the tumor cells rely upon to proliferate and metastasize), or more likely an aggregate effect of numerous secondary mechanisms of action.

In connection with the present invention, it would seem, without wishing to be bound by the theory, that masitinib optionally administered in combination with at least one antineoplastic agent promotes survival in the subpopulation of patients with cancer that is associated with pain or the requirement of opioid analgesics for the treatment of disease related pain via, but not limited to: controlling tumor proliferation via modulation of the tumor microenvironment and in particular through modulation of mast cell activity; modulation of immunostimulation-mediated anticancer effects; and antimetastatic effects. There exists direct or putative evidence linking masitinib's effect to each of these secondary mechanisms of action.

Of particular relevance is the fact that masitinib, through its inhibition of c-Kit, exerts a direct anti-proliferative and pro-apoptotic action on mast cells and indirectly therefore, reduces the array of pro-inflammatory and pro-angiogenic cytokines and chemokines that are important in tumor growth and tumor invasiveness. In addition to its antiproliferative properties, masitinib can also regulate the activation of mast cells through its targeting of Lyn and Fyn, key components of the transduction pathway leading to IgE induced mast cell degranulation [Gilfillan, 2006; Gilfillan, 2009]. This can be observed in the inhibition of FcεRI-mediated degranulation of human cord blood mast cells [Dubreuil et al., 2009]. Masitinib also strongly interacts with the DDR1, a kinase the deregulation capabilities of which are associated with tumor progression and poor prognosis in a number of human cancer [Davis et al., Nat Biotechnol 2011, 29(11): 1046-51]. Masitinib could therefore slow down the homing and colonization of tumor cells.

Evidence indicates that recruitment of inflammatory cells, especially infiltration by mast cells, facilitates the growth and spread of some cancers by producing molecules that enhance tumor invasiveness. Therefore, inhibition of mast cell function may prove to be of therapeutic benefit in restraining the growth of cancer, including pancreatic cancer. Furthermore, there is a known association between inflammation and pancreatic cancer development, with mast cells having an essential role in the immunopathological mechanisms of chronic inflammatory diseases. Indeed, mast cells have been directly linked to the development of pancreatic cancer tumorigenesis in mouse models, showing that high levels of mast cell infiltration into the tumor microenvironment was predictive of poor clinical outcome, although the exact mechanism by which mast cells contribute to pancreatic cancer development was not clear [Chang D Z et al., Clin Cancer Res 2011; 17:7015-7023].

Throughout the process of tumorigenesis, disease progression, and metastasis, the microenvironment of the local host tissue is an active participant and determines the extent of cancer cell proliferation, angiogenesis, invasion, and survival. The role of mast cells in the tumorigenesis of cancers is not well understood however, and there is conflicting data about their benefit or detriment to tumorigenesis, depending on the local stromal conditions and whether the mediators released facilitate the proliferation of tumor cells or induce the apoptosis of malignant cells [(Theoharides T C, et al., Trends Immunol 2004; 25:235-41); (Samoszuk M, et al., BMC Cancer 2005; 21:121); (Almholt K, et al., Recent Results Cancer Res 2003; 162:31-42); (Gooch J L, et al., Cancer Res 1998; 15:4199-205)].

The body of scientific evidence regarding the role of mast cells in tumor progression and invasion in pancreatic cancer, as well as the emerging role of mast cells in cancer pain lends credence to our findings from study AB07012. Moreover, without wishing to be bound to the theory, data from study AB07012 indicate that a previously unrecognized connection exists between mast cell activation, pancreatic cancer pathogenesis, and pancreatic cancer pain. That is to say, there is a correlation of mast cell activity with poor clinical outcome in pancreatic cancer, a correlation of cancer pain with poor clinical outcome, and a correlation of mast cell activity with cancer pain. Thus, the onset of disease related pain in pancreatic cancer can serve as a marker of mast cell activity, which in turn signals a more aggressive stage in the cancer's pathogenesis. In this scenario, we consider that to some degree the disease related pain of cancer patients, and in particular pancreatic cancer patients, is a cancer-induced neuropathologic by-product of changes in the tumor microenvironment; changes that are responsible for driving disease progression and metastasis, and which involve recruitment of mast cells or an increase in mast cell activation.

In connection with the present invention, the timing and severity of disease related pain can be considered as a marker of the cancer's pathogenesis, with increased mast cell activity being responsible in part for both tumor progression and disease related pain. Therefore, inhibition of mast cell activity is a plausible therapeutic target for the subpopulation of cancer patients presenting with disease related pain or the requirement of opioid analgesics for treatment of disease related pain. This is evident from the unexpected finding that masitinib administered in combination with gemcitabine increased overall survival in the subpopulation of pancreatic cancer patients with disease related pain. Additionally, data from study AB07012 showed that masitinib plus gemcitabine decreased overall survival in the subpopulation of pancreatic cancer patients with no disease related pain and no requirement of opioid analgesics for treatment of disease related pain. Hence, according to the predictor factor of pain intensity, and in the absence of any other independent predictor factor, it is inadvisable to treat patients from this latter subpopulation with masitinib.

Thus, a highly distinct subpopulation from the general pancreatic cancer population has been shown to benefit from the use of at least one compound of the invention (i.e. a tyrosine kinase inhibitor, mast cell inhibitor or c-Kit inhibitor, especially masitinib) administered in combination with at least one antineoplastic agent (especially gemcitabine). This subpopulation can be identified via assessment of disease related pain intensity; for example, but not restricted to, at least one occurrence of a non-zero Visual Analogue Scale (VAS) pain intensity score (especially with a cut-off at VAS>20, e.g. higher than 20 mm on a 100 mm scale), or equivalent measure of this pain intensity threshold. This subpopulation defines one embodiment of patients relevant to the present invention.

A number of biochemical markers are associated with pain, one or more of which may serve as surrogate markers to objectively support the pain intensity predictor factor described above. Such biochemical markers include, but are not restricted to, nerve growth factor (NGF), bradykinin, tryptase, histamine, neurotrophin-3 (NT-3), and brain-derived neurotrophic factor (BDNF). However, biochemical markers of pain are known to be variable and to date there is no conclusive evidence that they can quantitatively identify cancer patients experiencing disease related pain. Similarly, the known in vivo biochemical markers of mast cells, such as, but not restricted to, absolute mast cell count or tryptase levels, have been shown to poorly correlate with mast cell activation [Hermine O, et al., PLoS ONE. 2008; 3:e2266]. Thus, in the absence of reliable surrogate biochemical markers for mast cell activation or disease related pain, unidimensional tools remain the most appropriate pain assessment option available, even if this represents a relatively subjective measure of pain intensity or indirect evidence of mast cell involvement.

In connection with the present invention, it is possible to generalize upon the discovery (i.e. the concomitant increase in mast cell activity, poor clinical outcome in cancer, and disease related pain) to other cancers that involve recruitment of mast cells or an increase in mast cell activation. Explicitly, the onset of disease related pain serves as a marker of mast cell activity, which in turn signals changes in the tumor microenvironment that are responsible for driving disease progression and metastasis. However, the current absence of knowledge concerning in vivo mast cell mediated tumorigenesis and metastasis accompanied by onset of disease related pain for any given cancer, precludes any person skilled in the arts applying the principle of targeting mast cell activity for treatment of cancer that is associated with pain beyond that of heuristic 'trial and error'.

The main findings from study AB07012 regarding treatment of a patient subpopulation defined via a pain intensity predictor factor are summarized below (see also Example 1).

Figure 2:
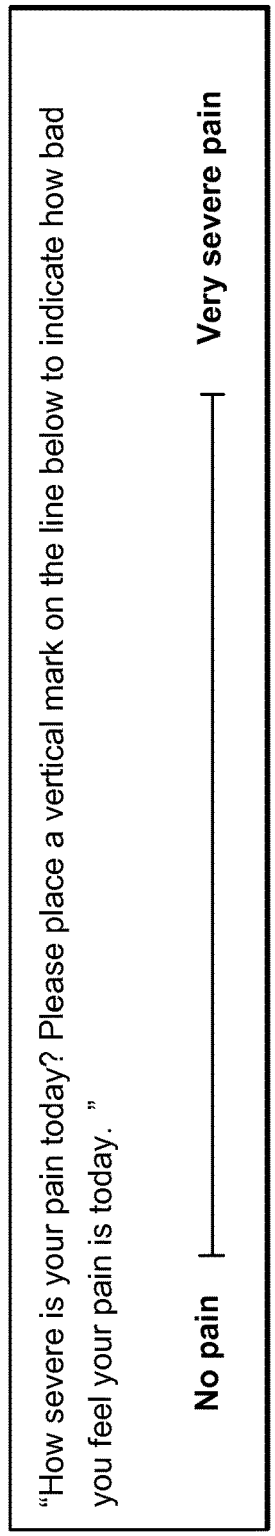

The subpopulation having pancreatic cancer that is associated with 'pain' was defined in this study as those patients with a baseline Visual Analogue Scale (VAS) pain intensity score of greater than 20 (i.e. VAS>20 mm as measured on a 100 mm scale). This linear scale provides a visual representation of pain amplitude as perceived by the patient (FIG. 2). The amplitude was represented by a 100 mm long line having no reference marks. One extremity indicated an absence of pain (0 value) and the other the worst imaginable pain (100 value). At baseline each patient was asked to indicate the level of pain intensity they were experiencing by drawing a vertical line on the VAS scale. It was considered that a patient with no pain, or negligible pain, would locate a vertical line between 0 and 5 on the VAS scale.

Any VAS score indicated herein refers to the absolute amplitude on a linear scale or equivalently a percentage; for example, a VAS pain intensity score of 20 corresponds to an indicated level of pain at 20 mm on a 100 mm scale, or alternatively at 20% of said scale. In connection with the present invention, any equivalent measure of this pain intensity threshold would be valid; for example, but not limited to, a unidimensional pain intensity assessment tool score of >20%, a criteria-based pain categorization of at least moderate pain; or a multidimensional pain assessment tool rating of at least moderate pain.

Another interpretation of this pain intensity threshold is that said cancer patients have a disease related pain of at least moderate intensity. The pain intensity predictor factor, in the embodiment as described above, was defined based upon the reasons: (1) this threshold was approximately (rounding to the nearest ten) the study population's median pain intensity (50% of the population); (2) a VAS pain intensity of 20 mm coincided with the emergence of a plateau (or horizontal asymptote) in the hazard ratio for death (see FIG. 1); (3) this threshold has been previously cited in the literature as a pain intensity cut-off.

For the subpopulation with VAS pain intensity VAS>20, or equivalent measure of pain intensity (referred to hereafter as the "pain subpopulation"), gemcitabine works best when administered in combination with masitinib. A statistically significant benefit, in terms of median overall survival and hazard ratio for death, was observed for combination masitinib plus gemcitabine treatment in patients with pancreatic cancer that is associated with pain at VAS>20.

For the subpopulation with VAS pain intensity <5, or equivalent measure of pain intensity, and with no need for opioid analgesics to manage disease related pain (referred to hereafter as the "no pain, no morphine subpopulation"), gemcitabine works best by itself; indicating that in the absence of any other independent predictor factor, treatment of this subpopulation with masitinib plus gemcitabine is inadvisable. Negative therapeutic benefit, in terms of median overall survival and hazard ratio for death, was observed for combination masitinib plus gemcitabine treatment in patients from the 'no pain, no morphine' subpopulation.

For the subpopulation with VAS pain intensity 5<VAS<20, or equivalent measure of pain intensity (referred to hereafter as the "below median pain subpopulation"), there was a statistically significant benefit in the hazard ratio, however, no difference was observed in terms of median overall survival. For this pain intensity subpopulation, there does not appear to be any increased harm or benefit in terms of survival due to the combination of masitinib with gemcitabine, indicating that this subpopulation is neutral (i.e. no harm will be done if masitinib is administered).

The frequency of deaths due to adverse events in the 'pain' subpopulation was reduced (two times lower) in the masitinib plus gemcitabine treatment arm than in the placebo plus gemcitabine arm (10.9% versus 21.9%, respectively). Toxicity of the masitinib plus gemcitabine combination were consistent with the known safety profile of masitinib and are all manageable, any risk of life threatening adverse events being greatly mitigated by anticipating their occurrence and implementing appropriate protocols, especially for severe neutropenia.

In one possible embodiment of the present invention, the use of at least one compound of the invention for the treatment of pancreatic cancer would depend upon, although not be restricted to, the following guidelines:

Treatment is indicated if the patient meets the 'pain' subpopulation criterion of VAS pain intensity >20, or equivalent measure of pain intensity, on at least one occasion.

At least one question could be asked to eliminate pain that is not relevant to pancreatic cancer, for example, the patient might be asked to indicate the localization of their pain.

Strict adherence to the rule of not treating the subpopulation of 'no pain, no morphine', in the absence of any other independent predictor factor, would protect those patients for whom the masitinib plus gemcitabine combination has been shown to be detrimental.

These guidelines are similar to those employed to diagnose the chronic pain condition of fibromyalgia, the established diagnostic criteria being to first exclude other underlying conditions that might be causing the pain related symptoms, then to assess the patient's pain (via patient questionnaire and physical examination).

The neutral subpopulation of patients ('below median pain', VAS≤20, or equivalent measure of pain intensity), for whom there was a statistically non-significant benefit in hazard ratio, provides a large buffer between the indicated treatment subpopulation and the subpopulation for whom said treatment is inadvisable. The diagnostic decision in terms of harm/no harm due to treatment effectively becomes a 'binary' indicator, with the condition of 'no pain, no morphine' being highly distinguishable from 'pain' (VAS>20). In the event of wrongly treating a patient who belongs to the 'below median pain' subpopulation, then there is no detriment to survival, with the only increased risk being due to manageable toxicity.

In connection with the present invention, effective treatment options for pancreatic cancer patients in the subpopulation of 'pain' (VAS>20) are nonexistent. The credibility of this statement is underscored by data from study AB07012 showing a pain intensity related discrepancy in survival time for patients receiving gemcitabine as a single agent, with an observed difference in survival time of 10.0 months between the 'pain' and 'no pain, no morphine' subpopulations (i.e. patients from the 'pain' subpopulation had a shorter survival time) (see Example 1). Moreover, in a study assessing erlobinib plus gemcitabine, no survival benefit for the equivalent 'pain' subpopulation was reported whereas benefit was apparent for patients with VAS pain intensity of <20. Finally, the benefit of Folfirinox for the subpopulation of pancreatic cancer with 'pain' (VAS>20) is at best unknown because pain was not factored into that study's analysis, an omission that given the significant influence pain intensity has on pancreatic cancer patient survival (as revealed by study AB07012 findings) would very likely impact negatively on the Folfirinox survival data.

Considering further the safety analysis from study AB07012, the overall frequency of adverse events (AE) were similar in both treatment arms, whilst the frequency of serious and severe AEs were higher in the masitinib plus gemcitabine treatment arm than in the placebo plus gemcitabine arm. Discontinuations, temporary interruptions and dose reductions occurred more frequently in the masitinib plus gemcitabine treatment arm as compared with the placebo plus gemcitabine arm. Adverse events leading to permanent discontinuations occurred in 42% vs. 27% of patients, respectively (p-value=0.002). Of these, non-severe AEs accounted for 32% of discontinuations from the masitinib plus gemcitabine treatment arm with only 16% of masitinib plus gemcitabine treated patients reporting a dose reduction. It is likely that discontinuations due to non-severe AE may partially be avoided by a more frequent use of masitinib dose reductions or by lowering the masitinib starting dose. By consequence, exposure to the study drug was significantly lower in the masitinib plus gemcitabine treatment arm (p=0.001). In the overall population, patient exposure to gemcitabine in the masitinib plus gemcitabine treatment arm was decreased by approximately 35% compared with the placebo plus gemcitabine treatment arm, with similar trends observed in the various pain intensity subpopulations. Taken together these observations on safety and drug exposure indicate that the administered masitinib dose of 9 mg/kg/day was not optimal for good patient compliance, in part due to additional toxicity associated with the combination. Considering also new insights regarding masitinib's inferred mechanisms of action, a masitinib dose of 6 mg/kg/day is considered to be the optimal starting dose, with dose escalation permitted in patients with an inadequate response in the absence of limiting toxicities.

The inventors also showed that gene expression is an independent predictor factor for improved survival in pancreatic cancer patients treated with masitinib plus gemcitabine. Thus, the present invention also relates to a method for the treatment of cancer in a human patient, wherein said method comprises administering to a human patient in need thereof, a tyrosine kinase inhibitor, mast cell inhibitor or c-Kit inhibitor, especially masitinib or a pharmaceutically acceptable salt thereof, optionally combined with at least one antineoplastic agent, wherein said patient is initially selected for treatment based upon gene expression predictor factors.

An ancillary pharmacogenomic analysis of RNA expression in peripheral blood cell samples collected prior to treatment with masitinib was carried out in parallel to study AB07012 with an aim to identify gene expression patterns predictive for overall survival and treatment efficacy. Genomic analyses (carried-out by Skuldtech, Montpellier, France) consisted of global transcriptome analysis of RNA expression using the high throughput method of Next Generation Sequencing (performed independently in triplicate). This analysis simultaneously measured the expression level of large numbers of genes in blood samples drawn from a subpopulation of patients randomized to study AB07012. Analyses were first carried out on the study's overall population whatever the treatment administered, followed by an analysis on each treatment arm i.e. masitinib or placebo arm, to determine possible genetic trends according to the treatment. The objectives of this ancillary study were to reveal biomarkers predictive of extended survival (i.e. increased OS) for masitinib treated patients as compared with placebo treated patients.

In particular, RNA blood samples were collected and analyzed, resulting in isolation of a gene expression profile indicative of aggressive disease progression, present in 55% of patients, which was highly predictive for overall survival and furthermore interacted with the treatment. This ancillary pharmacogenomic database contained blood RNA samples from 119 patients randomized to study AB07012 (1:1 ratio according to treatment arm) in order to detect gene expressions that correlated with treatment effect. In a first step the full human genome (~27,000 genes) was analyzed in terms of a possible correlation between RNA expression levels and overall survival, with respect to treatment type. RNA blood samples were collected using the PAXgene Blood RNA System and three independent Digital Gene Expression (DGE) libraries were constructed for four pooled RNA samples falling into the following patient profiles:

Patients in the masitinib plus gemcitabine treatment arm who survived ≤4 months
Patients in the placebo plus gemcitabine treatment arm who survived ≤4 months
Patients in the masitinib plus gemcitabine treatment arm who survived >15 months
Patients in the placebo plus gemcitabine treatment arm who survived >15 months The resultant genomic database contained 119 modified intent-to-treat patients from which 169 genes were identified through differential expression analysis using the edgeR method with a 1.5-fold change and a false discovery rate adjusted p-value criterion of <10%.

In a second step, real time quantitative PCR (real time quantitative polymerase chain reaction or qPCR) was performed, which allows one to determine the Cycle threshold (Ct) value of a gene, said value being normalized with respect to the expression level of a housekeeping or reference gene to give a Delta Ct (DCt) value. Housekeeping genes are genes that are expressed in all the cells of an organism under normal and pathophysiological conditions. These genes are usually expressed at relatively constant levels. Preferably, the normalization is based on the expression level of two housekeeping genes, and in particular, based on the expression level of genes B2M and GAPDH. Thus, when two housekeeping genes (for example, genes B2M and GAPDH) are used to normalize the Ct value of a given gene, the DCt of said gene is calculated as follows: DCt=Ct (gene)−[Ct (B2M)+Ct (GAPDH)]/2. High DCt values corresponded to a relatively lower level of gene expression.

The main methodological aspects of the ancillary pharmacogenomic study of trial AB07012 and subsequent results regarding treatment of a patient subpopulation defined via gene expression predictor factors, are summarized below (see also Example 2 for additional details).

Regarding measurement of gene expression, in one embodiment, the expression level of a gene is measured as the level of the protein of said gene. In that case, the level of the protein is preferably measured by employing antibody-based detection methods such as immunochemistry or western-blot analysis.

In another embodiment, the expression level of a gene is measured as the level of the RNA transcript or the cDNA of said genes. In that case, the level of RNA transcript(s) or the cDNA is measured by employing nucleic acid based detection methods such as microarrays, quantitative PCR, DNA chips, hybridization with labeled probes, or lateral flow immunoassays, in particular lateral flow dipstick tests. Preferably, the expression level of the gene is measured by real time quantitative PCR performed on the RNA transcript or the cDNA of said gene. A real time quantitative PCR is a PCR wherein the amplified DNA is detected as the reaction progresses in real time. This detection is made through the accumulation of a fluorescent signal. The Ct (cycle threshold) is defined as the number of PCR cycles required for the fluorescent signal to cross the threshold (i.e. exceed background level). Thus, a forward and a reverse primer, and a reporter, preferably a DNA fluorescent intercalant, are used in a qPCR. Advantageously, primers that are specific for hybridizing within the gene coding regions are used.

Below is a summary of the methodology and analytical processes used to define a set of gene expression predictor factors, and therefore, a patient subpopulation for which masitinib is most probable to be of therapeutic benefit.

This analysis simultaneously measured the expression level of large numbers of genes in peripheral blood cell samples drawn from a total of 119 patients randomized to the study AB07012 (1:1 ratio of masitinib and placebo treated patients).

Analyzed samples were taken once only at week 0 (baseline).

The PAXgene™ Blood RNA System was used to collect a patient's blood sample, and the RNA extracted using PAXgene Blood RNA Kit V.2 (PreAnalitix) according to the manufacturer's recommendations. Control of RNA integrity was performed with the 2100 Bioanalyzer (Agilent, Palo Alto, USA) using Eukaryotic Total RNA 6000 Nano Chip (Agilent Technologies). RNA quantity was controlled using NanoDrop ND-1000 spectrophotometer. Purified RNAs were conserved at −80° C.

Digital Gene Expression (DGE) experiments were performed to select set of putative biomarkers. Biomarker validation was done using Real-Time PCR on COBAS platform (LC480, ROCHE Diagnostics) and appropriate biostatistical approaches have been used to filter best biomarkers.

RNAs were reverse transcribed according the Roche Diagnostics' protocol. Gene expression levels of putative biomarkers were investigated by Real-Time PCR.

DGE analysis resulted in the selection of 169 genes, taken from a genomic database of 119 modified intent-to-treat patients.

For each gene three cut-offs with respect to DCt were specified: median, Q1 (first quartile, P25) and Q3 (third quartile, P75). By "median DCt", it is meant the median of the DCt of all of the tested patients. For each cut-off (less than cut-off/more than cut-off) a multivariate model was used to explain differences in overall survival between treatment arms. If the effect of treatment arm was significant (p<5%) then it can be concluded that the gene under investigation has a different effect on survival depending on the treatment arm, and that gene was retained for further analysis. Because of the importance of gene KIT, this gene was selected whatever its level of significance.

Multivariate analysis subsequently refined the gene selection down to a total of 64 genes with associated cut-off values.

All possible dual-gene combinations from these 64 genes and their respective cut-off values were subjected once again to the multivariate model.

Each combination was classified according to the discriminatory power of the combination measured by p-value of the Chi-squared test provided in the Cox model. An additional criterion for retaining a given dual-gene combination was that the subpopulation refined should contain at least 40 patients (⅓ of the total sample).

The ten individual genes found in the six identified gene expression predictor factors (i.e. pairs of regulated genes with p-values <0.00001) were: ACOX-1, TNFRSFS10B, RPS23, ABCC3, LYN, HIF1ALPHA, ABCC1, IGJ, UBE2H, and PARP-2.

The expression level of these genes was measured by real time quantitative PCR (real time quantitative polymerase chain reaction or qPCR) using primers that were specific for hybridizing within the gene coding regions.

In the case of the ACOX-1 gene, the primers amplify a sequence located on chromosome 17 between nucleotide 73,938,893 and nucleotide 73,939,007 (Assembly February 2009 GRch37/hg19, UCSC source).

In the case of the TNFRSF10B gene, the primers amplify a sequence located on chromosome 8 between nucleotide 22,877,657 and nucleotide 22,877,728 (Assembly February 2009 GRch37/hg19, UCSC source).

In the case of the RPS23 gene, the primers amplify a sequence located on chromosome 5 between nucleotide 81,571,951 and nucleotide 81,572,049 (Assembly February 2009 GRch37/hg19, UCSC source).

In the case of the ABCC3 gene, the primers amplify a sequence located on chromosome 17 between nucleotide 48,762,132 and nucleotide 48,762,221 (Assembly February 2009 GRch37/hg19, UCSC source).

In the case of the LYN gene, the primers amplify a sequence located on chromosome 8 between nucleotide 56,854,522 and nucleotide 56,860,210 (Assembly February 2009 GRch37/hg19, UCSC source).

In the case of the HIF1A gene, the primers amplify a sequence located on chromosome chromosome 14 between nucleotide 62,214,901 and nucleotide 62,214,976 (Assembly February 2009 GRch37/hg19, UCSC source).

In the case of the ABCC1 gene, the primers amplify a sequence located on chromosome 16 between the nucleotide 16,177,368 and nucleotide 16,180,772 (Assembly February 2009 GRch37/hg19, UCSC source).

In the case of the IGJ gene, the primers amplify a sequence located on chromosome 4 between the nucleotide 71,521,360 and nucleotide 71,521,432 (Assembly February 2009 GRch37/hg19, UCSC source).

In the case of the UBE2H gene, the primers amplify a sequence located on chromosome 7 between the nucleotide 129,470,836 and nucleotide 129,470,925 (Assembly February 2009 GRch37/hg19, UCSC source).

In the case of the PARP-2 gene, the primers amplify a sequence located on chromosome 14 between the nucleotide 20,825,213 and nucleotide 20,825,283 (Assembly February 2009 GRch37/hg19, UCSC source).

In one embodiment, the following primers can be used to perform the real time quantitative PCR:

```
GAPDH
                              (SEQ ID NO: 1)
primer forward:    ATGGGGAAGGTGAAGGTCG (SEQ ID NO: 2)
primer reverse:    GGGGTCATTGATGGCAACAATA B2M
                              (SEQ ID NO: 3)
primer forward:    GCTCAGTAAAGACACAACCATCC (SEQ ID NO: 4)
primer reverse:    CATCTGTGGATTCAGCAAACC ABCC1
                              (SEQ ID NO: 5)
primer forward:    CCAGTGGGGATCGGACAGA (SEQ ID NO: 6)
primer reverse:    AGGGGATCATCGAAGAGGTAAAT ACOX1
                              (SEQ ID NO: 7)
primer forward:    TTTCTTCACTGCAGGGCTTT (SEQ ID NO: 8)
primer reverse:    GGAAAGGAGGGATTTTGAGC HIF1A
                              (SEQ ID NO: 9)
primer forward:    TTTTGCTCTTTGTGGTTGGA (SEQ ID NO: 10)
primer reverse:    CCTGGTCCACAGAAGATGTTT IGJ
                              (SEQ ID NO: 11)
primer forward:    GGACATAACAGACTTGGAAGCA (SEQ ID NO: 12)
primer reverse:    TGGCAATTTCTTACACTAACCTGA TNFRSF10B
                              (SEQ ID NO: 13)
primer forward:    GGTTTCATATTTAATTTGGTCATGG (SEQ ID NO: 14)
primer reverse:    CAAACAAGGAAGCACATTGTGTA RPS23
                              (SEQ ID NO: 15)
primer forward:    GATTTGGTCGCAAAGGTCAT (SEQ ID NO: 16)
primer reverse:    TGCCTTTGTATAGGGCCAAA ABCC3
                              (SEQ ID NO: 17)
primer forward:    GGAGGACATTTGGTGGGCTTT (SEQ ID NO: 18)
primer reverse:    CCCTCTGAGCACTGGAAGTC LYN
                              (SEQ ID NO: 19)
primer forward:    ATCCAACGTCCAATAAACAGCA (SEQ ID NO: 20)
primer reverse:    AAGGCTACCACAATGTCTCCT PARP2
                              (SEQ ID NO: 21)
primer forward:    GGGAAAGGAATCTACTTTGCTG (SEQ ID NO: 22)
primer reverse:    TTCTTTAGGCGAGAGGCAAA UBE2H
                              (SEQ ID NO: 23)
primer forward:    CGCAGGTTTTCCACTCATCT (SEQ ID NO: 24)
primer reverse:    ATGGCCATTTCTTCCCAAG
```

| Name | Description | Gene identifiant Sequence Id. (Ensembl) | Example of mRNA sequences Sequence Id. (Genbank) |
|---|---|---|---|
| ACOX1 | Acyl-CoA oxidase 1, palmitoyl | ENSG00000161533 (SEQ ID NO 25) | NM_001185039.1 (SEQ ID NO: 35) NM_004035.6 (SEQ ID NO: 36) NM_007292.5 (SEQ ID NO: 37) |
| TNFRSF10B | Tumor necrosis factor receptor superfamily, member 10b | ENSG00000120889 (SEQ ID NO 26) | NM_003842.4 (SEQ ID NO: 38) NM_147187.2 (SEQ ID NO: 39) |

-continued

| Name | Description | Gene identifiant Sequence Id. (Ensembl) | Example of mRNA sequences Sequence Id. (Genbank) |
|---|---|---|---|
| ABCC1 | ATP-binding cassette, sub-family C (CFTR/MRP), member 1 | ENSG00000103222 (SEQ ID NO 27) | NM_004996.3 (SEQ ID NO: 40) |
| ABCC3 | ATP-binding cassette, sub-family C (CFTR/MRP), member 3 | ENSG00000108846 (SEQ ID NO 28) | NM__001144070.1(SEQ ID NO: 41) NM_003786.3 (SEQ ID NO: 42) |
| HIF1A | Hypoxia inducible factor 1, alpha subunit | ENSG00000100644 (SEQ ID NO 29) | NM_001243084.1(SEQ ID NO: 43) NM_001530.3 (SEQ ID NO: 44) |
| LYN | V-yes-1 Yamaguchi sarcoma viral related oncogene homolog | ENSG00000254087 (SEQ ID NO 34) | NM__001111097.2(SEQ ID NO: 45) NM_002350.3 (SEQ ID NO: 46) |
| IGJ | Immunoglobulin J polypeptide, linker protein for immunoglobulin alpha and mu polypeptides | ENSG00000132465 (SEQ ID NO 30) | NM_144646.3 (SEQ ID NO: 47) |
| UBE2H | Ubiquitin-conjugating enzyme E2H | ENSG00000186591 (SEQ ID NO 31) | NM_001202498.1 (SEQ ID NO: 48) NM_003344.3,(SEQ ID NO: 49) |
| PARP2 | Poly (ADP-ribose) polymerase 2 | ENSG00000129484 (SEQ ID NO 32) | NM_001042618.1(SEQ ID NO: 50) NM_005484.3(SEQ ID NO: 51) |
| RPS23 | Ribosomal protein S23 | ENSG00000186468 (SEQ ID NO 33) | NM_001025.4(SEQ ID NO: 52) |
| GAPDH | glyceraldehyde-3-phosphate dehydrogenase | ENSG00000111640 | NM_002046 (SEQ ID NO: 53) NM_001256799 (SEQ ID NO: 54) |
| B2M | beta-2 microglobulin | ENSG00000166710 | NM_004048.2 (SEQ ID NO: 55) |

The two housekeeping genes used were B2M and GAPDH. In the case of the B2M gene, the amplified sequence is located on chromosome 15 between nucleotides 45,010,919 and nucleotides 45,010,990 (Assembly February 2009 GRch37/hg19, UCSC source).

In the case of the GAPDH gene, the amplified sequence is located on chromosome 12 between nucleotides 6,643,999 and nucleotides 6,645,738 (Assembly February 2009 GRch37/hg19, UCSC source).

Advantageously, for performing the real-time quantitative PCR, primers, size (preferably between 80 and 150 nucleotides), Tm (melting temperature, preferably 60° C.±1° C.), GC % (percentage of G or C nucleotide, preferably ~60% in 3'), 3' and 5' self-complementarity and stability (preferably inferior to 4 nucleotides), product size ranges and thermodynamic parameters (secondary structure evolution according primer Tm and sodium salt concentration) are selected to allow a simultaneous detection.

Having identified these ten genes and six gene expression predictor factors, a pooling strategy was finally implemented to identify the most common/specific gene expression profile and discard individual variations or outliers (e.g. due to sample manipulation error). Sample pooling is a method frequently used in epidemiology when individual studies are too small to allow any definite conclusion.

Hence, the most significant dual-gene combination was chosen first (and then the following information was recorded: number of patients in the subpopulation, Hazard Ratio (HR); p-value of the Cox model. Next, the second most significant dual-gene combination was added in order to increase the sample size and also the power of analyses. The same information as above was recorded. The process of selection was stopped when no (or few) additional patients were added to the sample size following addition of a new combination, with the condition also that Hazard Ratio and/or p-value were maintained (see Example 2, Table 5).

The process was stopped after six combinations (66 patients in total) with the final selection of dual-gene combinations (referred to hereafter individually as the "gene expression predictor factors" or collectively as the "genetic/transcriptional fingerprint") being:

The concomitant up-regulation of genes ACOX-1 and TNFRSF10B with patient Delta Cycle Threshold values of less than or equal to 3.05 for ACOX-1 and less than or equal to 6.1 for TNFRSF10B; (HR=0.19, p-value=0.0091).

The concomitant down-regulation of gene RPS23 and up-regulation of gene ACOX-1 with patient Delta Cycle Threshold values of greater than 0.35 for RPS23 and less than or equal to 3.05 for ACOX-1; (HR=0.20, p-value=0.00046).

The concomitant up-regulation of genes ABCC3 and LYN with patient Delta Cycle Threshold values of less than or equal to 4.3 for ABCC3 and less than or equal to 1.65 for LYN; (HR=0.19, p-value=0.00025).

The concomitant up-regulation of genes HIF1A and TNFRSF10B with patient Delta Cycle Threshold values of less than or equal to 3.95 for HIF1A and less than or equal to 5.65 for TNFRSF10B; (HR=0.19, p-value=0.00013).

The concomitant down-regulation of gene ABCC1 and up-regulation of gene IGJ with patient Delta Cycle Threshold values of greater than 3.5 for ABCC1 and less than or equal to 7.05 for IGJ; (HR=0.19, p-value=0.000011).

The concomitant down-regulation of genes UBE2H and PARP-2 with patient Delta Cycle Threshold values of greater than 3.7 for UBE2H and greater than 7.1 for PARP-2; (HR=0.192, p-value=0.000004).

Note, it is understood that slight modifications to the above defined cut-offs are encompassed herein (for example, ±10% or even ±25% of the stated cut-offs) to reflect the fact that the optimal threshold may be located in proximity to those cut-offs tested and that the patient cohort is only representative of a general cancer population.

OS was analyzed in the subpopulation identified as harboring at least one of the gene expression predictor factors, referred to hereafter as the "genetic fingerprint" or "transcriptional fingerprint" subpopulation (65 patients), and in its counterpart, i.e. patients that did not present any of the gene expression predictor factors, referred to hereafter as the "non genetic fingerprint" or "non transcriptional fingerprint" subpopulation (53 patients).

Analysis of the 'genetic fingerprint' subpopulation showed that patients in the masitinib plus gemcitabine treatment arm had a median OS of 12.9 months as compared with 4.7 months in patients receiving placebo plus gemcitabine (multivariate analysis). After adjustment for differences in baseline characteristics, the difference in median OS proved to be statistically significant (p-value <0.000001) with a hazard ratio for death (defined as the probability of death under masitinib plus gemcitabine over the probability of death under placebo plus gemcitabine) of 0.17 with a 95% confidence interval of [0.09;0.34]. Thus, patients harboring at least one of the aforementioned gene expression predictor factors, and therefore identified as belonging to the defined 'genetic fingerprint' subpopulation, have a 83% decrease in risk of death when treated with the combination of masitinib plus gemcitabine as compared with gemcitabine alone. Considering a worst case scenario of the higher confidence interval boundary, i.e. 0.34, the risk of death for patients in the 'genetic fingerprint' subpopulation was still reduced by 66% when treated with masitinib plus gemcitabine. The Kaplan-Meier estimates for the 'genetic fingerprint' subpopulation clearly showed that survival probability is consistently higher and that survival rates from 6 to 24 months were favorable for masitinib plus gemcitabine treatment as compared with gemcitabine treatment alone (see Example 2, FIG. 7).

By contrast, analysis of the 'non genetic fingerprint' subpopulation showed a median OS of 5.6 months for masitinib plus gemcitabine treatment as compared with 13.2 months in patients receiving placebo plus gemcitabine (multivariate analysis). The difference in median OS was statistically significant (p-value=0.000036) with a hazard ratio for death (defined as the probability of death under masitinib plus gemcitabine over the probability of death under placebo plus gemcitabine) of 4.24 with a 95% confidence interval of [2.11;8.52] in the multivariate model (see Example 2, FIG. 8). Thus, the risk of death for patients not harboring at least one of the aforementioned gene expression predictor factors is higher when treated with the combination of masitinib plus gemcitabine as compared with gemcitabine alone. Therefore, said treatment of any patient in the 'non genetic fingerprint' subpopulation, and in the absence of any other positive predictor factor, is inadvisable.

It was observed that there was no correlation between the genomic data and baseline VAS pain intensity status, i.e. with respect to the pain intensity predictor factor. This was true for the overall genomic population (119 patients), for the 'genetic fingerprint' and 'non genetic fingerprint' subpopulations. In connection with the present invention, it would therefore seem likely, without wishing to be bound by the theory, that the predictor factors of pain intensity and gene expression are associated with independent mechanisms of disease progression. Therefore, treatment of masitinib is of therapeutic benefit to a patient who is positive for one predictor factor but negative for another; i.e., no contradiction exists.

Considering gene expression as an independent predictor factor, the treatment management plan is simply a binary choice between administering masitinib, optionally combined with at least one antineoplastic agent, to those patients identified as having the appropriate genetic fingerprint, and not administering masitinib to patients lacking said genetic fingerprint. The treatment management plan for the pain intensity predictor factor is more complex and must take into consideration different thresholds for pain intensity and existing treatment regimens. Thus, in one embodiment of the invention, the discovery of specific and independent predictor factors leads us to propose a new therapeutic management plan in pancreatic cancer patients according to the scheme presented in FIG. 3.

Thus, in a first embodiment, the invention relates to a method of treatment of cancer in human patients, wherein a tyrosine kinase inhibitor, mast cell inhibitor or c-Kit inhibitor, especially masitinib or a pharmaceutically acceptable salt thereof, is administered in a patient in need thereof, optionally combined with at least one antineoplastic agent.

The compound of the invention and the at least one optional antineoplastic agent may be administered separately, simultaneously or sequentially in time.

According to a particular embodiment, said tyrosine kinase inhibitor, mast cell inhibitor or c-Kit inhibitor, especially masitinib or a pharmaceutically acceptable salt thereof, is administered in combination with at least one antineoplastic agent for the treatment of cancer, wherein said patient is either naïve to said at least one antineoplastic agent or responding to treatment with said at least one antineoplastic agent.

In another embodiment, said tyrosine kinase inhibitor, mast cell inhibitor or c-Kit inhibitor, especially masitinib or a pharmaceutically acceptable salt thereof, is administered in combination with at least one antineoplastic agent for the treatment of cancer, wherein said patient is refractory or resistant to said at least one antineoplastic agent.

The invention also relates to a tyrosine kinase inhibitor, mast cell inhibitor or c-Kit inhibitor, notably as defined above, especially masitinib, optionally combined with at least one antineoplastic agent, for use as a medicament or in a pharmaceutical composition for a method as defined in the description.

The invention also relates to a kit comprising at least a tyrosine kinase inhibitor, mast cell inhibitor or c-Kit inhibitor, notably as defined above, especially masitinib, optionally with at least one antineoplastic agent, for use in a method for the treatment of a cancer as defined in the present description and examples.

In one embodiment the present invention relates to the method as defined above wherein a tyrosine kinase inhibitor or a mast cell inhibitor is an inhibitor of kinase activity selected from the tyrosine kinases of: c-Kit, PDGFR, Lyn, Fyn and DDR1.

According to one embodiment the present invention relates to the method as defined above, wherein said patient is initially selected for treatment based upon the predictor factor of pain intensity.

Thus, in one embodiment the present invention relates to a method of treatment of cancer that is associated with pain or that requires administration of opioid analgesics for treatment of disease related pain, in a human patient, wherein a tyrosine kinase inhibitor, mast cell inhibitor or c-Kit inhibitor, especially masitinib or a pharmaceutically acceptable salt thereof, is administered to a patient in need thereof, optionally combined with at least one antineoplastic agent.

In one embodiment, said patient is considered to be in the indicated treatment subpopulation if on at least one occasion said patient presents with disease related pain defined as a non-zero Visual Analogue Scale (VAS) pain intensity score, or equivalent measure of pain intensity.

In other embodiments, said patient is considered to be in the indicated treatment subpopulation if on at least one occasion said patient presents with disease related pain defined as a VAS pain intensity score of greater than 5 (e.g. VAS>5 mm as measured on a 100 mm scale, or 5%); or a VAS pain intensity score of greater than 10 (e.g. VAS>10 mm as measured on a 100 mm scale, or 10%); or even a VAS pain intensity score of greater than 20 (e.g. VAS>20 mm as measured on a 100 mm scale, or 20%).

In another embodiment, said patient is considered to be in the indicated treatment subpopulation if on at least one occasion said patient presents with disease related pain defined by an equivalent measure of said VAS>20 pain intensity threshold. Said patients is also considered to be in the indicated treatment subpopulation if on at least one occasion said patient presents with disease related pain intensity classified as being moderate to intolerable pain.

In one embodiment, individual disease related pain intensity is defined and assessed as disclosed above.

In another embodiment the present invention relates to the method as defined above wherein said patient is afflicted by pancreatic cancer that is associated with pain or that requires administration of opioid analgesics for treatment of disease related pain, and wherein 'pain' is defined as at least one reported occurrence of a Visual Analogue Scale (VAS) pain intensity score of greater than 20 (e.g. VAS>20 mm as measured on a 100 mm scale, or 20%).

In one embodiment, treatment of said patient is considered to be inadvisable if, in the absence of any other independent predictor factor, said patient presents no disease related pain and no requirement of opioid analgesics for treatment of disease related pain.

According to one embodiment the present invention relates to the method as defined above, wherein said patient is initially selected for treatment based upon gene expression predictor factors.

According to one embodiment, said gene expression predictor factors are derived from analysis of RNA expression in peripheral blood cell samples collected prior to treatment with said tyrosine kinase inhibitor, mast cell inhibitor or c-Kit inhibitor, especially masitinib or a pharmaceutically acceptable salt thereof.

According to an embodiment, said patient is considered to be in the indicated treatment subpopulation if the gene expression in peripheral blood cell samples collected prior to administration of the compound of the invention shows a concomitant up-regulation or down-regulation of at least two genes selected from: ACOX-1, TNFRSFS-10B, RPS23, ABCC3, LYN, HIF-1A, ABCC1, IGJ, UBE-2H, or PARP-2. For example, dual-gene combinations include, but are not restricted to: the concomitant up-regulation of genes ACOX-1 and TNFRSF10B; the concomitant down-regulation of gene RPS23 and up-regulation of gene ACOX-1; the concomitant up-regulation of genes ABCC3 and LYN; the concomitant up-regulation of genes HIF1A and TNFRSF10B; the concomitant down-regulation of genes ABCC1 and IGJ; the concomitant down-regulation of genes UBE2H and PARP-2.

In one embodiment, the concomitant up-regulation of genes ACOX-1 and TNFRSF10B corresponds to patient Delta Cycle Threshold values of less than or equal to 3.81 for ACOX-1 and less than or equal to 7.63 for TNFRSF10B; more preferably to patient Delta Cycle Threshold values of less than or equal to 3.36 for ACOX-1 and less than or equal to 6.71 for TNFRSF10B; and even more preferably to patient Delta Cycle Threshold values of less than or equal to 3.05 for ACOX-1 and less than or equal to 6.1 for TNFRSF10B.

In one embodiment, the concomitant down-regulation of gene RPS23 and up-regulation of gene ACOX-1 corresponds to patient Delta Cycle Threshold values of greater than 0.26 for RPS23 and less than or equal to 3.81 for ACOX-1; more preferably to patient Delta Cycle Threshold values of greater than 0.32 for RPS23 and less than or equal to 3.36 for ACOX-1; and even more preferably to patient Delta Cycle Threshold values of greater than 0.35 for RPS23 and less than or equal to 3.05 for ACOX-1.

In one embodiment, the concomitant up-regulation of genes ABCC3 and LYN corresponds to patient Delta Cycle Threshold values of less than or equal to 5.38 for ABCC3 and less than or equal to 2.06 for LYN; more preferably to patient Delta Cycle Threshold values of less than or equal to 4.73 for ABCC3 and less than or equal to 1.82 for LYN; and even more preferably to patient Delta Cycle Threshold values of less than or equal to 4.3 for ABCC3 and less than or equal to 1.65 for LYN.

In one embodiment, the concomitant up-regulation of genes HIF1A and TNFRSF10B corresponds to patient Delta Cycle Threshold values of less than or equal to 4.94 for HIF1A and less than or equal to 7.06 for TNFRSF10B; more preferably to patient Delta Cycle Threshold values of less than or equal to 4.35 for HIF1A and less than or equal to 6.22 for TNFRSF10B; and even more preferably to patient Delta Cycle Threshold values of less than or equal to 3.95 for HIF1A and less than or equal to 5.65 for TNFRSF10B.

In one embodiment, the concomitant down-regulation of genes ABCC1 and IGJ corresponds to patient Delta Cycle Threshold values of greater than 2.63 for ABCC1 and less than or equal to 5.29 for IGJ; more preferably to patient Delta Cycle Threshold values of greater than 3.15 for ABCC1 and less than or equal to 6.35 for IGJ; and even more preferably to patient Delta Cycle Threshold values of greater than 3.5 for ABCC1 and less than or equal to 7.05 for IGJ.

In one embodiment, the concomitant down-regulation of genes UBE2H and PARP-2 corresponds to patient Delta Cycle Threshold values of greater than 2.78 for UBE2H and greater than 5.33 for PARP-2; more preferably to patient Delta Cycle Threshold values of greater than 3.33 for UBE2H and greater than 6.39 for PARP-2; and even more preferably to patient Delta Cycle Threshold values of greater than 3.7 for UBE2H and greater than 7.1 for PARP-2.

In another embodiment, the present invention relates to a method of treatment of cancer, wherein a tyrosine kinase inhibitor, mast cell inhibitor or c-Kit inhibitor, especially masitinib or a pharmaceutically acceptable salt thereof, optionally combined with at least one antineoplastic agent, is administered to a patient in need thereof, wherein said patient has a peripheral blood up-regulation of the gene ACOX-1, or homologous thereof.

In one embodiment, the up-regulation of gene ACOX-1 corresponds to patient Delta Cycle Threshold value of less than or equal to 3.81; more preferably of less than or equal to 3.36; and even more preferably of less than or equal to 3.05.

A preferred salt of masitinib is masitinib mesilate.

According to another embodiment, a compound of the invention is to be administered at a daily dose of 4.5 to 12.0 mg/kg/day, with the preferred starting daily dose of 6.0 to 7.5 mg/kg/day.

Optionally, a compound of the invention is dose escalated by increments of 1.5 mg/kg/day to reach a maximum of 12.0 mg/kg/day.

Optionally, a compound of the invention is dose reduced by increments of 1.5 mg/kg/day to reach a minimum of 4.5 mg/kg/day.

Dose adjustment can be considered a dynamic process, with a patient undergoing multiple increases and/or decreases to optimize the balance between response and toxicity throughout treatment, both of which are likely to vary over time and duration of drug exposure. If dose escalation is undertaken, it is suggested that the starting dose of 6.0 mg/kg/day be incremented by 1 to 2 mg/kg/day up to a maximum dose of 12.0 mg/kg/day, over a period which depends upon clinical observations. For example, a single dose escalation of said tyrosine kinase inhibitor, mast cell inhibitor or c-Kit inhibitor, especially masitinib or a pharmaceutically acceptable salt thereof, and preferably masitinib mesilate, may take from 1 to 2 months. It is also contemplated herein that to fully obtain the therapeutic benefits of a patient-optimized dose of said tyrosine kinase inhibitor, mast cell inhibitor or c-Kit inhibitor, especially masitinib or a pharmaceutically acceptable salt thereof, dose increments smaller than 1 to 2 mg/kg/day could be implemented. Dose reduction is to be considered to reduce toxicity in appropriate cases.

Any dose indicated herein refers to the amount of active ingredient as such, not to its salt form.

Given that the masitinib dose in mg/kg/day used in the described dose regimens refers to the amount of active ingredient masitinib, compositional variations of a pharmaceutically acceptable salt of masitinib mesilate will not change the said dose regimens.

Said compound of the invention is preferably administered orally.

Said compound of the invention is preferably administered twice a day.

Advantageously, the use or method comprises a long term administration of an effective amount of said tyrosine kinase inhibitor, mast cell inhibitor or c-Kit inhibitor, especially masitinib or a pharmaceutically acceptable salt thereof, over more than 3 months, preferably more than 6 months.

In one preferred embodiment the present invention relates to the method as defined above, wherein said tyrosine kinase inhibitor, mast cell inhibitor or c-Kit inhibitor, especially masitinib or a pharmaceutically acceptable salt thereof, is administered for the treatment of unresectable advanced or metastatic adenocarcinoma pancreatic cancer, optionally combined with at least one antineoplastic agent, and wherein said patient is in need thereof, as defined by the predictor factor of either gene expression or pain intensity.

The at least one antineoplastic agent can be a medicament for the treatment of cancers, and is preferably selected from the group consisting of gemcitabine (Gemzar®; Lilly), erlotinib (Tarceva®; Roche), paclitaxel (Taxol®, Abraxane®; Bristol-Myers Squibb), Folfirinox, 5-fluorouracil (5-FU), capecitabine, cisplatin, oxaliplatin, irinotecan, leucovorin, and any combination of these antineoplastic agents.

According to a particular embodiment, the invention also relates to a method of treatment of pancreatic cancer, wherein a tyrosine kinase inhibitor, mast cell inhibitor or c-Kit inhibitor, especially masitinib or a pharmaceutically acceptable salt thereof, is administered optionally in combination with gemcitabine.

Regarding best dosage regimen, depending on age, individual condition, mode of administration, and the clinical setting, effective doses of said tyrosine kinase inhibitor, mast cell inhibitor or c-Kit inhibitor, especially masitinib or a pharmaceutically acceptable salt thereof, in human patients with pancreatic cancer are 4.5 to 9.0 mg/kg/day per os, preferably in two daily intakes. For adult human patients with pancreatic cancer a starting dose of said tyrosine kinase inhibitor, mast cell inhibitor or c-Kit inhibitor, especially masitinib or a pharmaceutically acceptable salt thereof, of 6.0 to 7.5 mg/kg/day has been found to be the preferred embodiment according to the invention. For patients with an inadequate response after an assessment of response to therapy and in the absence of limiting toxicities, dose escalation of said tyrosine kinase inhibitor, mast cell inhibitor or c-Kit inhibitor, especially masitinib or a pharmaceutically acceptable salt thereof, to a maximum of 9.0 mg/kg/day can be safely considered and patients may be treated as long as they benefit from treatment and in the absence of limiting toxicities. For patients experiencing treatment related toxicity, dose of said tyrosine kinase inhibitor, mast cell inhibitor or c-Kit inhibitor, especially masitinib or a pharmaceutically acceptable salt thereof, can be reduced by increments of 1.5 mg/kg/day to reach a minimum of 4.5 mg/kg/day in intolerant patients, as long as they benefit from treatment and in the absence of limiting toxicities at said dose.

In another embodiment, said tyrosine kinase inhibitor, mast cell inhibitor or c-Kit inhibitor, especially masitinib or a pharmaceutically acceptable salt thereof, is administered at a starting daily dose of 6.0 to 7.5 mg/kg/day, and gemcitabine is administered at a weekly dose of 1000±250 mg/m2 of patient surface area for up to seven consecutive weeks as a start (from 3 to 7 weeks), followed by a week off-treatment, followed by cycles of weekly dose of 1000±250 mg/m2 for 3 weeks, every 28 days. For gemcitabine, it shall be understood that slight modification of the above dosage regimen is encompassed herein. For example, every 28 days means that one cycle is 3 weeks under treatment and 1 week off-treatment.

According to a particular embodiment, the composition of the invention is an oral composition.

As is known to the person skilled in the art, various forms of excipients can be used adapted to the mode of administration and some of them can promote the effectiveness of the active molecule, e.g. by promoting a release profile rendering this active molecule overall more effective for the treatment desired.

The pharmaceutical compositions of the invention are thus able to be administered in various forms, more specially for example in an injectable, pulverizable or ingestible form, for example via the intramuscular, intravenous, subcutaneous, intradermal, oral, topical, rectal, vaginal, ophthalmic, nasal, transdermal or parenteral route. A preferred route is oral administration. The present invention notably covers the use of a compound according to the present invention for the manufacture of pharmaceutical composition.

Such medicament can take the form of a pharmaceutical composition adapted for oral administration, which can be formulated using pharmaceutically acceptable carriers well known in the art in suitable dosages. Such carriers enable the pharmaceutical compositions to be formulated as tablets, pills, dragees, capsules, liquids, gels, syrups, slurries, suspensions, and the like, for ingestion by the patient. In addition to the active ingredients, these pharmaceutical compositions may contain suitable pharmaceutically-acceptable carriers comprising excipients and auxiliaries which facilitate processing of the active compounds into preparations which can be used pharmaceutically. Further details on techniques for formulation and administration may be found in the latest edition of Remington's Pharmaceutical Sciences (Maack Publishing Co., Easton, Pa.).

IN THE DRAWINGS

FIG. 1: Hazard ratio for death versus VAS score in the multivariate analysis;

FIG. 2: Example of VAS scale and user instructions.

Figure 4:
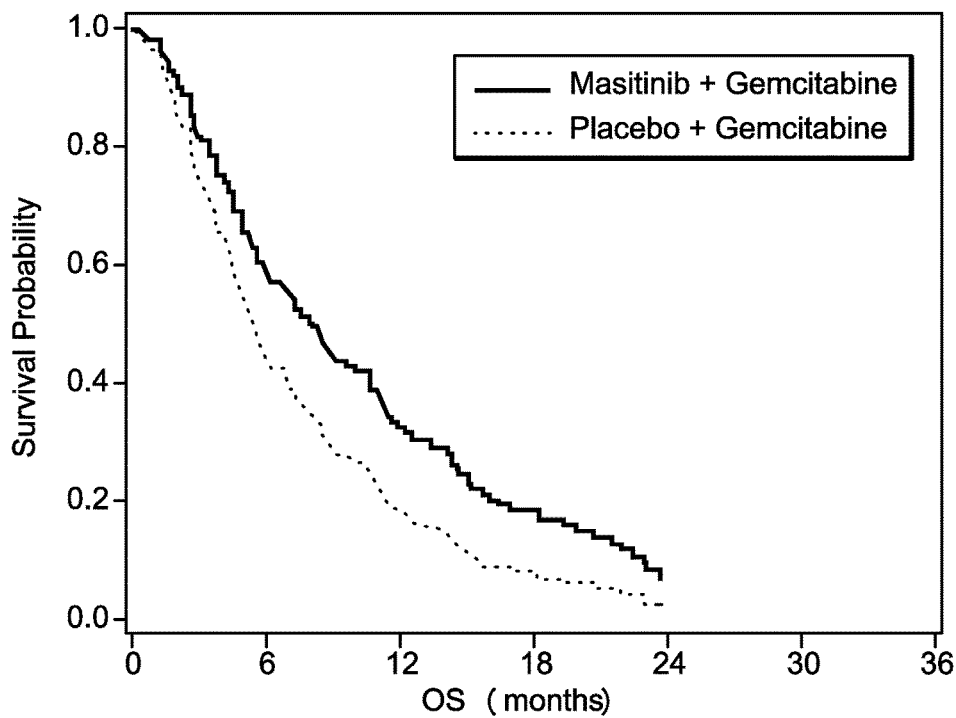

FIG. 3: Treatment management plan based upon predictor factors of pain intensity and gene expression;

FIG. 4: Survival probability estimates for the 'pain' subpopulation (multivariate analysis)

Figure 5:
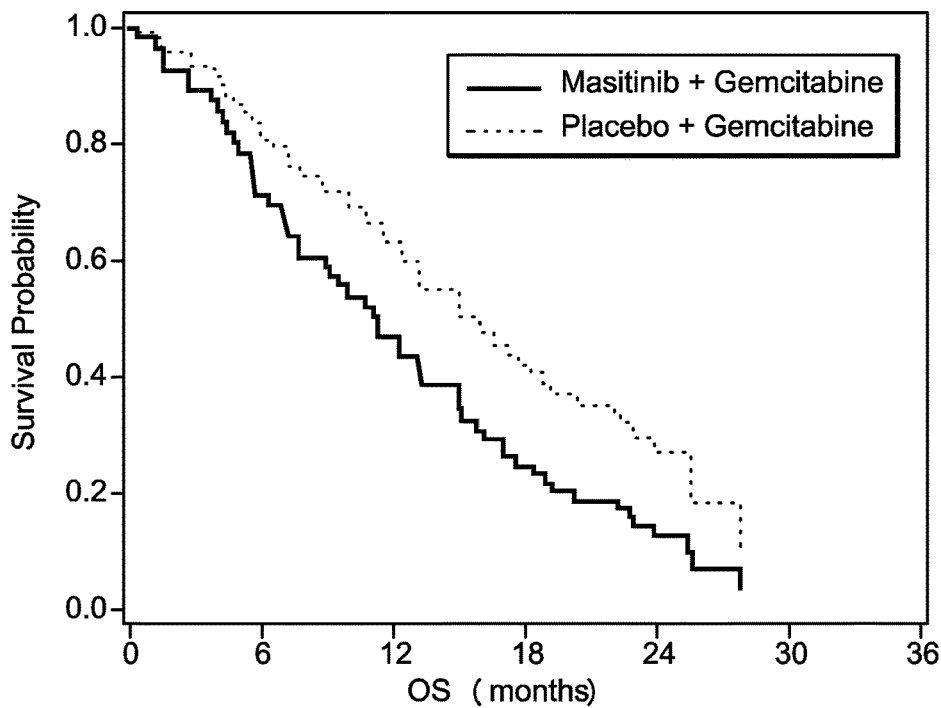

FIG. 5: Survival probability for 'no pain, no morphine' subpopulation (multivariate analysis)

Figure 6:
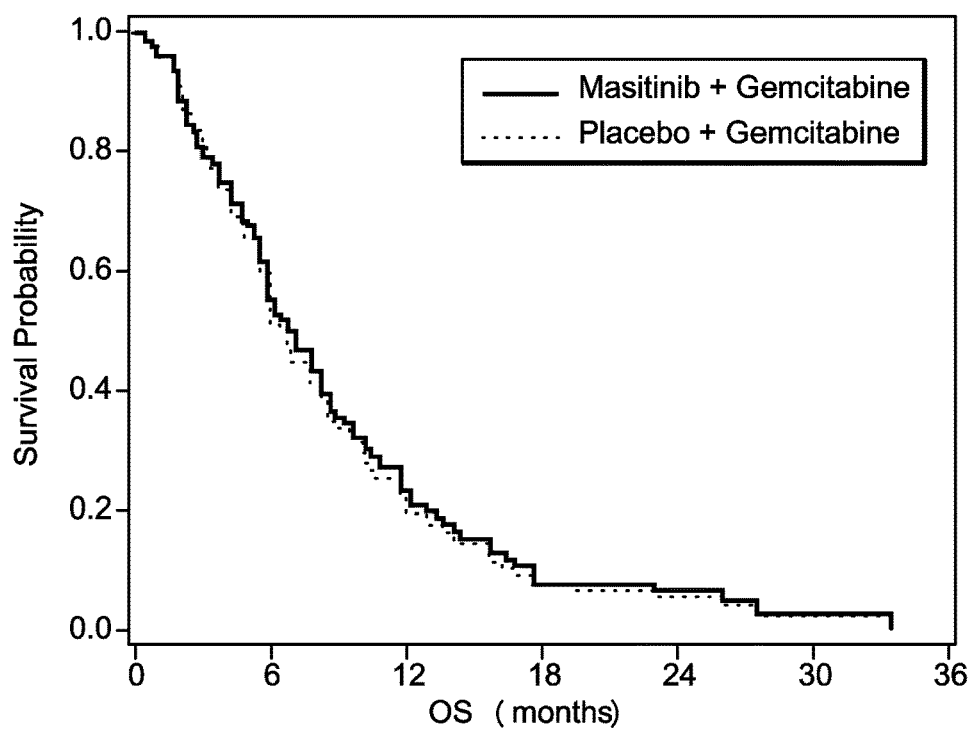

FIG. 6: Kaplan-Meier estimates for survival probability for 'below median pain' subpopulation (multivariate analysis)

Figure 7:
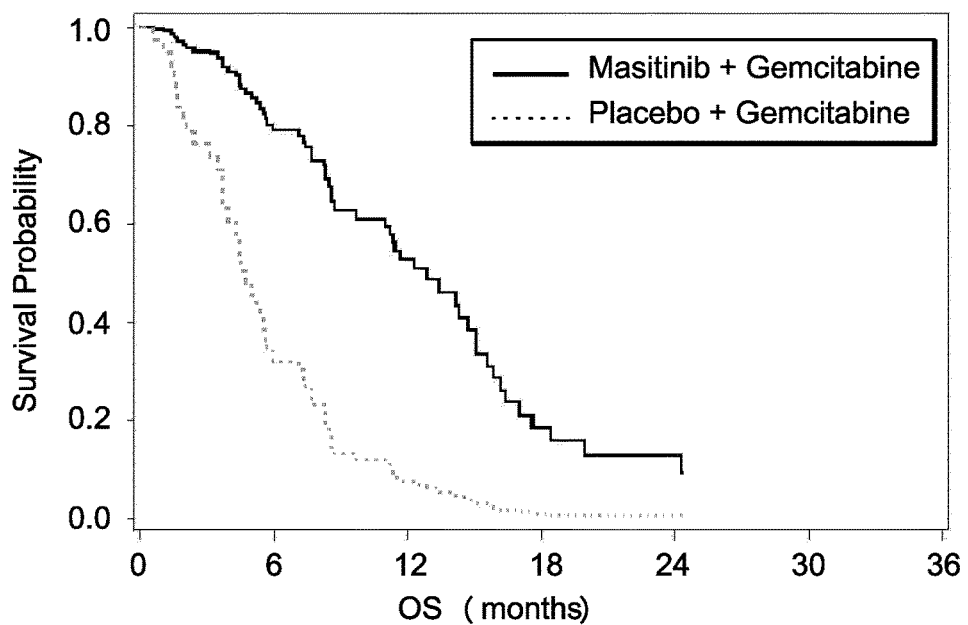

FIG. 7—Survival probability for 'genetic fingerprint' subpopulation (multivariate analysis)

Figure 8:
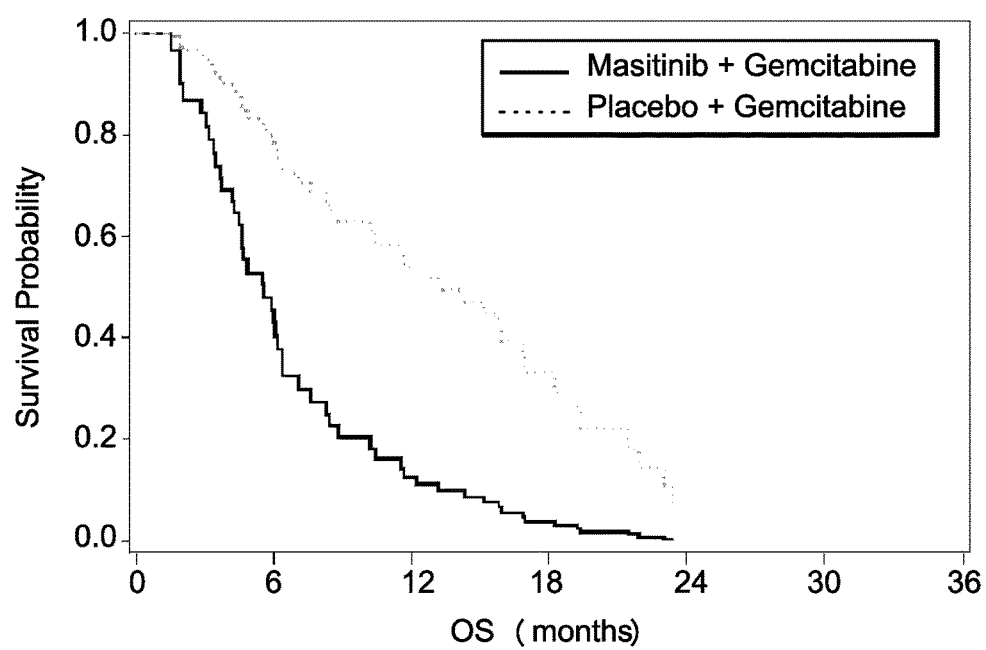

FIG. 8—Survival probability for the 'non genetic fingerprint' subpopulation (multivariate analysis)

The present invention is further illustrated by means of the following examples.

The data presented in these examples, and also in parts of the patent Description, are in part taken from preliminary analysis and as such represent a close approximation to the final, validated dataset.

Example 1: Randomized, Placebo Controlled, Phase 3 Study to Evaluate Efficacy and Safety of Masitinib in Combination with Gemcitabine for Treatment of Patients with Advanced/Metastatic Pancreatic Cancer The development plan in pancreatic cancer carried out by AB Science to evaluate efficacy and safety of masitinib in combination treatment with gemcitabine in this indication was based on the following clinical study: Study AB07012 "A prospective, multicenter, randomized, double-blind, placebo-controlled, 2-parallel group, phase 3 study to compare efficacy and safety of masitinib at 9 mg/kg/day in combination with gemcitabine, to placebo in combination with gemcitabine, in treatment of patients with advanced/metastatic pancreatic cancer". The cut-off date for efficacy and safety analyses was Mar. 1, 2012 corresponding to the date of unblinding.

Description of the AB07012 Study Population

The intent-to-treat (ITT) population was defined as all randomized patients whether they had received the study treatment or not. The mITT (modified Intent-To-Treat) population included all ITT patients except for patients withdrawn prematurely from the study for a well-documented non treatment-related cause. The ITT population of study AB07012 consisted of 353 patients, enrolled from 11 Nov. 2008 to 6 Jul. 2010 (last patient included): 175 patients in the masitinib plus gemcitabine treatment arm and 178 patients in the placebo plus gemcitabine treatment arm. Clinical efficacy was analyzed on the mITT population, defined as the ITT population excluding five patients. Two patients from the masitinib plus gemcitabine treatment arm received neither masitinib nor gemcitabine. Of the two patients from the placebo plus gemcitabine treatment arm, one was treated with neither placebo nor gemcitabine, and the other received gemcitabine but no placebo. The fifth patient to be excluded was allocated to the placebo plus gemcitabine treatment arm but did not have pancreatic cancer.

Thus, the mITT population consisted of 348 patients:
173 patients treated with masitinib plus gemcitabine
175 patients treated with placebo plus gemcitabine Description of Populations Analyzed for Clinical Efficacy According to the Predictor Factor of Pain Intensity Three subpopulations have emerged from the analysis of baseline characteristics, treatment type, and efficacy, and were defined as follows:

'Pain': patients with disease related pain defined as visual analogue scale (VAS) pain intensity score >20 (N=137: 64 and 73 in the masitinib plus gemcitabine, and placebo plus gemcitabine treatment arms, respectively).

'No pain, no morphine': patients with disease related pain defined as VAS [0-5] and with no need for opioid analgesics (N=68: 34 patients each in the masitinib plus gemcitabine, and placebo plus gemcitabine treatment arms).

'Below median pain': all other patients not belonging to the 'pain' and 'no pain, no morphine' subpopulations (N=107: 57 and 50 patients in the masitinib plus gemcitabine, and placebo plus gemcitabine treatment arms, respectively).

The 'pain' subpopulation, as described above, was defined based upon the reasons:

From multivariate analysis on overall survival in study AB07012, pain intensity was identified as a main factor (variable) impacting overall survival. In addition, interactions were found between the variable of pain intensity and the combination treatment administered to patients.

Results obtained from study AB07012 on overall survival showed that masitinib plus gemcitabine significantly increased overall survival of patients with pancreatic cancer that was associated with pain intensity of VAS>20 mm, compared with placebo plus gemcitabine.

Results on overall survival showed that OS decreased in the placebo plus gemcitabine treatment arm with increasing pain intensity.

A VAS pain intensity of 20 mm coincided with the emergence of a plateau (or horizontal asymptote) in the hazard ratio for death.

In a similar study on pancreatic cancer therapy by Moore et al. a VAS of 20 mm was reported as the VAS pain assessment cut-off. In that study, a erlotinib plus gemcitabine combination did not demonstrate any additional benefit on overall survival as compared with patients receiving placebo plus gemcitabine for patients with VAS>20; hazard ratio of 1.00 (95% CI [0.78; 1.27]) [Moore M J, et al., J Clin Oncol. 2007 May 20; 25(15):1960-6].

In the scientific literature several other publications reported clinical results including VAS scores with a cut-off at 20 mm [(Marineo G. J Pancreas 2003; 4(1): 1-10); (Zaza C, et al., J Pain Symptom Manage, 2002; 24:526-542)].

Clinical efficacy was evaluated through the analysis of overall survival (OS) in the overall population and in the three pain intensity subpopulations as defined above. Pain intensity was evaluated using the visual analogue scale, a linear scale that provides a visual representation of pain amplitude as perceived by the patient. The amplitude was represented by a 100 mm long line having no reference marks. One extremity indicated an absence of pain (0 value) and the other the worst imaginable pain (100 value). In practice, prior to receiving the investigational treatment (i.e. at baseline) each patient was asked to indicate the level of pain sensation they were experiencing by drawing a vertical line on the VAS scale. It was considered that a patient with no pain, or negligible pain, at baseline would locate a vertical line between 0 and 5 on the VAS scale.

Overall Survival Efficacy Analysis for Study AB07012

Overall survival was the primary endpoint of this study. OS was measured from the date of randomization to the date of documented death. If death was not observed, data on OS were censored at the last date the patient was known to be alive. OS was investigated at each baseline characteristic through a univariate analysis in patients having received the placebo plus gemcitabine treatment, to determine variables that may impact overall survival independently from the treatment. The main differences in OS results (statistical significance at 5%, data not shown) were observed in the baseline characteristics of: VAS scale for pain intensity; locally advanced/metastatic cancer; albumin level (normal/abnormal); and localization of primary tumor in the body of the pancreas. The parameter with the greatest impact on overall survival was pain intensity. While disease related pain has previously been associated with overall survival, it has never been demonstrated that pain intensity is the most important factor for overall survival. The impact of pain intensity on the overall survival of patients with pancreatic cancer is thus considered as a major discovery. Because these variables, and in particular pain intensity, clearly showed an impact on overall survival in patients treated with the placebo plus gemcitabine combination treatment, it was expected that any differences in baseline characteristics between both combination treatment arms would also impact overall survival. A univariate model is not suitable, even when stratified on two variables (here, country and metastases/locally advanced), and was therefore replaced by a multivariate Cox model in order to identify the effect of the combination treatment on overall survival. Results obtained from the multivariate Cox analysis on overall survival are presented below in the overall population, and in the three VAS pain intensity subpopulations ('pain'; 'no pain, no morphine'; and 'below median pain').

Multivariate Overall Survival Analyses for Determination of the Pain Intensity Predictor Factor The impact of each variable on overall survival and treatment efficacy was investigated via construction of a multivariate model, in which variables were selected through a stepwise procedure using 5% thresholds for both entry and maintenance of the variables. The final multivariate model included the following factors:

Treatment arm whatever its level of significance

Factors selected with the "stepwise" multivariate model: locally advanced/metastatic cancer, localization of primary tumor in the body of the pancreas, albumin level (normal/abnormal), and VAS pain assessment assigned to three VAS pain intensity subpopulations (as defined above).

Interactions were validated graphically via Kaplan-Meier estimates (by treatment arm and by factor modality).

Table 2 summarizes the statistically significant variables identified by the multivariate analysis Cox model for the overall population.

TABLE 2

Analysis and development of a multivariate Cox model including treatment arm in the overall population

| Overall Survival | Univariate Cox model Hazard ratio [95% CI] | $X^2$ p-value | Multivariate stepwise 5% selection Cox model $X^2$ p-value | Final Multivariate Cox model with treatment arm Hazard ratio [95% CI] | $X^2$ p-value |
|---|---|---|---|---|---|
| Treatment arm (masitinib/Placebo) | 1.01 [0.81; 1.26] | 0.922 | Not selected | 0.89 [0.70; 1.13] | 0.344 |
| Sex (Female/Male) | 0.79 [0.63; 0.99] | 0.040 | Not selected | | |
| Age (>65years Yes/No) | 1.01 [0.81; 1.27] | 0.928 | Not selected | | |
| Metastatic/Locally Advanced | 1.55 [1.11; 2.17] | 0.010 | 0.018 | 1.55 [1.09; 2.22] | 0.016 |
| ECOG (1/0) | 1.60 [1.27; 2.02] | <0.001 | Not selected | | |
| Country (France Yes/No) | 0.74 [0.59; 0.94] | 0.011 | Not selected | | |
| Pain VAS (mm)-continuous | 1.01 [1.00; 1.01] | 0.001 | Not selected | | |
| Pain VAS-by class ([0;5];[5;20]; >20) | 1.69 [1.29; 2.23] (>20 versus [0;5]) | <0.001 | <0.001 | 2.00 [1.50; 2.66] (>20 versus [0;5]) | <0.001* |
| Clinically significant CA 19-9 (Yes/No) | 1.19 [0.91; 1.55] | 0.196 | Not selected | | |
| Liver Metastases (Yes/No) | 1.35 [1.06; 1.72] | 0.013 | Not selected | | |
| Metastases Lymph Nodes (Yes/No) | 1.39 [1.05; 1.83] | 0.022 | Not selected | | |
| Weight (>65 kg Yes/No) | 1.03 [0.83; 1.29] | 0.790 | Not selected | | |
| Localization Head (Yes/No) | 0.99 [0.79; 1.23] | 0.903 | Not selected | | |
| Localization Body (es/No) | 0.84 [0.66; 1.06] | 0.148 | 0.026 | 0.74 [0.57; 0.96] | 0.021 |
| Localization Tail (yes/No) | 1.10 [0.87; 1.41] | 0.424 | Not selected | | |

TABLE 2-continued

Analysis and development of a multivariate Cox model including treatment arm in the overall population

| Overall Survival | Univariate Cox model Hazard ratio [95% CI] | $X^2$ p-value | Multivariate stepwise 5% selection Cox model $X^2$ p-value | Final Multivariate Cox model with treatment arm Hazard ratio [95% CI] | $X^2$ p-value |
|---|---|---|---|---|---|
| BMI (kg/m$^2$) - continuous | 1.00 [0.98; 1.02] | 0.959 | Not selected | | |
| Gamma GT (Normal/Abnormal) | 0.69 [0.53; 0.91] | 0.007 | Not selected | | |
| Albumin (Normal/Abnormal) | 0.29 [0.20; 0.42] | <0.001 | <0.001 | 0.29 [0.20; 0.44] | <0.001* |

*Significant interaction with treatment: p = 0.008

Results obtained from this multivariate model showed no effect on survival of the combination treatment in the overall population, but revealed a significant impact from four variables: pain intensity (p<0.001), the albumin level (p<0.001), the tumor classification as metastatic or locally advanced (p=0.016), and the localization of the primary tumor in the body of the pancreas (p=0.021). These variables were therefore retained in the multivariate model for OS. Surprisingly, these data led to a discovery that pain intensity according to the defined VAS subpopulations at baseline is a critical variable with a significant impact on OS of patients with pancreatic cancer. A multivariate analysis was therefore performed in subpopulations according to the baseline VAS pain intensity subpopulations, following the same procedure as previously done on the overall population. Table 3 summarizes results of the multivariate analysis on OS in the overall population, and in each of the three VAS pain intensity subpopulations.

Results from the multivariate analysis confirmed that patients treated with masitinib plus gemcitabine had no statistically significant survival advantage over the placebo plus gemcitabine treatment arm for the overall population. Based upon our findings that the baseline pain intensity correlated strongly with OS, this parameter was further investigated to determine whether there existed any interaction between this variable, the combination treatment type, and overall survival; i.e. OS as a function of VAS pain intensity score was analyzed for both treatment arms (masitinib versus placebo). Similar curves would correspond to no interaction between the two variables, whereas separated curves would indicate an interaction. A significant and strong interaction between the VAS scale evaluating pain intensity and the combination treatment used was revealed, as evidenced by a p-value of 0.010 for the 'pain' subpopulation and 0.041 for the 'no pain, no morphine' subpopulation (Table 3). The graphical validation of interactions showed that median OS in patients VAS>20 was lower in the placebo plus gemcitabine treatment arm as compared with the masitinib plus gemcitabine treatment arm; hazard ratio of 0.61 (95% CI [0.42; 0.88]) (FIG. 4). On the contrary, median OS in patients with a VAS [0;5] (i.e. the 'no pain, no morphine' subpopulation) was higher in the placebo plus gemcitabine treatment arm compared with the masitinib plus gemcitabine treatment arm; hazard ratio of 1.63 (95% CI [0.94; 2.85]) (FIG. 5). This highlights the key importance of the variable pain intensity for analysis of OS in patients with cancer.

In the overall population, multivariate analysis on overall survival showed no significant impact of the combination treatment on OS with a p-value of 0.740 and a hazard ratio for death with its 95% confidence interval of 0.90 (95% CI [0.71; 1.14]). Median OS was 7.7 months (95% CI [6.1; 10.6]) in patients treated with the masitinib plus gemcitabine combination treatment and 7.0 months (95% CI [5.8; 9.6]) receiving placebo plus gemcitabine, respectively. OS rates at 6, 12, 18, and 24 months were respectively, 59.2%, 32.1%, 17.3%, and 9.5% for masitinib plus gemcitabine, versus 56.0%, 28.5%, 14.5%, and 7.5% for placebo plus gemcitabine.

TABLE 3

Results on overall survival after multivariate analysis in the overall population and in each VAS pain intensity subpopulation

| | Treatment | N | p-value* | Hazard ratio [95% CI] | Median OS (months) | OS rates (months) [95% CI] | | | |
|---|---|---|---|---|---|---|---|---|---|
| | | | | | | M6 | M12 | M18 | M24 |
| Overall population | M + G | 173 | 0.740 | 0.90 [0.71; 1.14] | 7.7 [6.1; 10.6] | 59.2 [51.2; 69.3] | 32.1 [24.1; 43.4] | 17.3 [11.2; 27.3] | 9.5 [5.2; 17.7] |
| | P + G | 175 | | | 7.0 [5.8; 9.6] | 56.0 [47.9; 66.4] | 28.5 [21.0; 39.5] | 14.5 [9.1; 23.7] | 7.5 [3.9; 14.8] |
| 'Pain' | M + G | 64 | 0.010 | 0.61 [0.42; 0.88] | 8.1 [5.9; 11.5] | 58.2 [48.5; 71.7] | 32.2 [22.2; 47.9] | 18.2 [10.4; 32.9] | ≤6.4* [2.5; 17.3] |
| | P + G | 73 | | | 5.4 [4.5; 8.0] | 43.9 [33.7; 58.7] | 17.8 [10.5; 31.3] | 7.8 [3.6; 18.0] | ≤2.0* [0.5; 8.2] |

TABLE 3-continued

Results on overall survival after multivariate analysis in the overall population and in each VAS pain intensity subpopulation

| | Treatment | N | p-value* | Hazard ratio [95% CI] | Median OS (months) | OS rates (months) [95% CI] | | | |
|---|---|---|---|---|---|---|---|---|---|
| | | | | | | M6 | M12 | M18 | M24 |
| 'No pain, no morphine' | M + G | 34 | 0.041 | 1.63 [0.94; 2.85] | 11.4 [7.2; 22.2] | 71.1 [56.5; 89.8] | 46.9 [30.2; 74.4] | 24.5 [11.4; 56.6] | 12.5 [4.0; 43.9] |
| | P + G | 34 | | | 15.4 [11.4; NA] | 81.1 [69.8; 94.3] | 62.7 [46.9; 84.4] | 41.8 [25.4; 71.1] | 27.2 [13.2; 60.0] |
| 'Below median pain' | M + G | 57 | 0.976 | 0.95 [0.63; 1.41] | 6.7 [5.6; 10.3] | 57.3 [45.5; 74.4] | 22.8 [12.9; 41.4] | 8.5 [3.2; 23.4] | 6.3 [2.0; 20.1] |
| | P + G | 50 | | | 6.4 [5.6; 10.0] | 55.6 [44.0; 73.3] | 21.0 [11.7; 39.7] | 7.4 [2.6; 22.5] | 5.4 [1.6; 19.4] |

M + G: masitinib plus gemcitabine;
P + G: placebo plus gemcitabine.
*Log-rank p-value.

In the 'pain' subpopulation, (patients with disease related pain defined as VAS>20), the masitinib plus gemcitabine combination significantly increased overall survival of patients with pancreatic cancer and with a pain intensity VAS score >20 compared with placebo plus gemcitabine, as evidenced by a p-value of 0.01. The hazard ratio for death (defined as the probability of death under masitinib plus gemcitabine over the probability of death under placebo plus gemcitabine) was 0.61 (95% CI [0.42; 0.88]), meaning that the risk for death in patients treated with masitinib plus gemcitabine was significantly decreased by 39% compared with patients treated with placebo plus gemcitabine. Considering a worst case scenario of the higher confidence interval boundary, i.e. 0.88, the risk of death for patients in the 'pain' subpopulation was still reduced by 12% when treated with masitinib plus gemcitabine. Median OS in the masitinib plus gemcitabine treatment arm was 8.1 months whereas it was only 5.4 months in the placebo plus gemcitabine treatment arm. Survival rates at 6, 12, 18, and 24 months were respectively, 58.2%, 32.2%, 17.2%, and ≤6.4% in the masitinib plus gemcitabine treatment arm, versus 43.9%, 17.8%, 7.8%, and ≤2.0% in the placebo plus gemcitabine treatment arm. The Kaplan-Meier estimates for the multivariate model of this subpopulation are shown in FIG. 4. The therapeutic advantage of the masitinib plus gemcitabine treatment over placebo plus gemcitabine is clearly seen in the multivariate model, in which the masitinib plus gemcitabine survival probability is consistently higher.

In the 'no pain, no morphine' subpopulation (patients with disease related pain defined as VAS [0-5] and with no need for opioid analgesics for treatment of disease related pain) the placebo plus gemcitabine treatment arm was shown to significantly increased overall survival of patients with pancreatic cancer as compared with the masitinib plus gemcitabine arm, as evidenced by a p-value of 0.041 and a hazard ratio for death of 1.63 (95% CI [0.94; 2.85]). This multivariate analysis supported the conclusion that, in the absence of any other independent predictor factors, administration of masitinib plus gemcitabine for treatment of patients afflicted by pancreatic cancer that is not associated with pain or the requirement of opioid analgesics for the treatment of disease related pain is inadvisable.

The Kaplan-Meier estimates for the multivariate model of this subpopulation are shown in FIG. 5.

In the subpopulation 'below median pain' (i.e. patients with disease related pain defined as 5<VAS<20) the treatment was not identified through the multivariate Cox model as having a significant impact on overall survival with a p-value of 0.976 and a hazard ratio for death of 0.95 (95% CI [0.63; 1.41]). This subpopulation was therefore considered as neutral. The Kaplan-Meier estimates for the multivariate model of this subpopulation are shown in FIG. 6. From this Kaplan-Meier plot it is evident that the two curves representing survival probability are almost identical, and therefore, the 'below median pain' subpopulation is neutral towards masitinib plus gemcitabine treatment. This is important when taking into consideration that treatment of the 'no pain, no morphine' subpopulation with masitinib plus gemcitabine is inadvisable, the 'below median pain' subpopulation therefore effectively representing a large buffer between the thresholds for treatment and non-treatment, which greatly mitigates any risk of a patient receiving treatment that would be of detriment to their survival.

Additionally, it is noted that patients with disease related pain defined as VAS>20 might ultimately require opioid analgesics to manage their pain and subsequently their pain might be reduced to a VAS score ≤5 mm. However, this subpopulation of patients, defined as "no pain but a requirement for opioid analgesics", was also shown to be a neutral subpopulation (data not shown).

Safety Analysis for Study AB07012

In the subpopulation of patients with 'pain' (VAS>20), the frequency of adverse events (AE) was similar in both treatment arms (100%). The frequencies of serious AEs and severe AEs were higher in the masitinib treatment arm (68.8% and 85.9% of patients, respectively) than in the placebo treatment arm (56.2% and 71.2%, respectively). AEs leading to gemcitabine discontinuation or interruption were more frequent in the masitinib plus gemcitabine treatment arm than in the placebo plus gemcitabine arm. These trends were repeated in the overall population; i.e. frequency of AEs was similar in both treatment arms and the frequency of serious and severe AEs, as well as discontinuation or interruption of gemcitabine treatment, were higher in the masitinib plus gemcitabine treatment arm than in the placebo plus gemcitabine arm.

The exposure to gemcitabine in the masitinib plus gemcitabine treatment arm as compared with the placebo plus gemcitabine treatment arm was decreased by approximately: 35% in the overall population; 30% in the 'pain' subpopulation; 30% in the 'below median pain' subpopulation; and 45% in the 'no pain, no morphine' subpopulation. Overall, patients from the masitinib plus gemcitabine treatment arm received masitinib for a mean of 3.0 months while patients from the placebo plus gemcitabine arm received placebo for a mean of 4.3 months. Therefore, exposure to the study drug was significantly lower in the masitinib plus gemcitabine arm (p=0.001). This lower exposure to the study drug was highlighted by the intensity of the drug dose received by patients during the study: 34.7% of patients from the masitinib plus gemcitabine arm receiving less than 80% of the initially planned dose versus 17.1% of patients from the placebo plus gemcitabine arm.

Taken together these observations on adverse events and drug exposure indicate that the administered masitinib dose of 9 mg/kg/day is not optimal for patient compliance, in part due to additional toxicity associated with the combination. Considering also new insights regarding masitinib's inferred mechanisms of action, a masitinib dose of 6 mg/kg/day is considered to be the optimal starting dose, with dose escalation permitted in patients with inadequate response and in the absence of limiting toxicities.

Study AB07012 Efficacy Conclusions According to the Predictor Factor of Pain Intensity One objective of study AB07012 was to compare the efficacy of masitinib plus gemcitabine, with that of placebo plus gemcitabine in treatment of patients with unresectable locally advanced and/or metastatic pancreatic cancer. In the overall population, masitinib plus gemcitabine treatment did not show statistically significant improvements in the median overall survival of patients. However, multivariate analysis on different baseline characteristics identified pain intensity as the single most important factor with predictive power for overall survival. Three subpopulations have emerged according to the following criteria:

'Pain': VAS>20
'No pain, no morphine': VAS<5
'Below median pain': VAS=[5-20]

Stratification according to these subpopulations showed that for patients receiving placebo plus gemcitabine (i.e. gemcitabine as a single agent) the median OS was 15.4 months in the 'no pain, no morphine' subpopulation compared with 5.4 months in the 'pain' subpopulation, corresponding to a difference of 10.0 months in median OS between these two subpopulations. In contrast, masitinib plus gemcitabine treatment was shown to significantly prolong median overall survival in the 'pain' subpopulation with a median OS of 8.1 months, and a hazard ratio of 0.61 (95% CI [0.42;0.88]), meaning that the risk of death is decreased by 39% in the masitinib plus gemcitabine treatment arm compared with the placebo plus gemcitabine treatment arm (p-value=0.01). The hazard ratio was inverted in the 'no pain, no morphine' subpopulation, being 1.63 (95% CI [0.94; 2.85]) with a p-value of 0.041. Therefore, according to the predictor factor of pain intensity, and in the absence of any other independent predictor factor, said treatment of patients in the 'no pain, no morphine' subpopulation is inadvisable.

To summarize, our analysis has led to the discovery of pain intensity being strongly predictive for overall survival in pancreatic cancer patients. The combination of masitinib plus gemcitabine treatment has proven efficacious in the subpopulation defined by at least one reported occurrence of a Visual Analogue Scale (VAS) pain intensity score of greater than 20 (e.g. VAS>20 mm as measured on a 100 mm scale, or 20%). This subpopulation has the poorest prognosis in overall survival and hence a very high unmet medical need. In the 'pain' subpopulation, accounting for approximately 43.9% of patients, median OS was 5.4 months with placebo plus gemcitabine, whereas it was 15.4 months in the 'no pain, no morphine' subpopulation and 6.4 months in the 'below median pain' population. Masitinib plus gemcitabine treatment significantly improved overall survival in the 'pain' population: median OS was 8.1 months as compared with 5.4 months in the placebo plus gemcitabine treatment arm (p-value=0.010). The hazard ratio was 0.61 (95% CI of [0.42; 0.88]), showing that the risk of death was decreased by 39% with masitinib plus gemcitabine as compared with the control treatment arm. Overall survival rates at 12, 18, and 24 months were respectively, 32%, 18% and ≤6.4% as compared with 18%, 8% and ≤2.0% in the placebo plus gemcitabine treatment arm.

Example 2: Genomic Analyses of Study AB07012 to Investigate Predictive Criteria of Efficacy An ancillary pharmacogenomic study was performed to define predictive criteria of efficacy from genomic data. That is to say, identification of genes that were down-regulated or up-regulated in a randomized subset of pancreatic cancer patients taken from study AB07012, and that could be correlated to overall survival and clinical benefit of the investigational treatment. The main findings from this ancillary study regarding treatment of a patient subpopulation defined via gene expression predictor factors are presented above in the section: 'Description of the Invention'. Here, additional or supplemental details on the techniques used are provided.

Skuldtech Protocol for Gene Expression Analysis

Genomic analyses consisting of global transcriptome analysis of peripheral blood cell samples collected prior to treatment with masitinib using high throughput method and Next Generation Sequencing (performed independently in triplicate) was performed by Skuldtech (Montpellier, France). The identification of genes whose expression correlated with overall survival and treatment type relied on a multistep process. Presented below are extracts taken from the Skuldtech protocol (steps 1 to 7), followed by general discussion on certain methodological aspects for differential gene expression.

1. Sample Collection and Handling:
   Total blood samples from patients in PAXgene tubes in ice dry (shipper: LabConnect, USA) were received and stored at −80° C.
   Collected tubes belong to 119 patients before treatment, and are named Week 0.
   Total RNA was extracted from the blood samples of 119 patients before treatment, and named week 0. The transcriptome analysis (biomarker investigation) was conducted only on this time point.
   All of the 119 RNA samples were analyzed. If some samples received were not eligible for analysis due to insufficient quality material, they were not used.
   Digital Gene Expression (DGE) experiments were carried out to select a set of putative biomarkers.
   Biomarker validation was done using Real-Time PCR on COBAS platform (LC480, ROCHE Diagnostics) and appropriate biostatistical approaches have been used to filter for best biomarkers.

2. RNA Samples:
   119 blood RNA samples corresponding to baseline blood samples, were extracted from blood (PAXgene Blood collection tubes, BD) using PAXgene Blood RNA Kit V.2 (PreAnalitix) according to manufacturer's recommendations.
   Control of RNA integrity was performed with the 2100 Bioanalyzer (Agilent Technologies, Palo Alto, USA) using Eukaryotic Total RNA 6000 Nano Chip (Agilent Technologies). RNA quantity was controlled using NanoDrop ND-1000 spectrophotometer. Purified RNAs were conserved at −80° C.

3. DGE Library Construction and Tag-to-Gene Mapping:

Twelve Digital Gene Expression (DGE) libraries were constructed from pooled blood RNA samples of patients. For each of the four treatment groups (i.e. Placebo/Gemcitabine P or Masitinib+Gemcitabine M & dead before month 4, M4, or alive after month 15, M15), three DGE libraries were constructed using the same pooled blood RNA samples (three technical replicates). The libraries were constructed with Illumina's DGE Tag Profiling kit according to the manufacturer's protocol (version 2.1B), using 5 μg of total RNA (equal amounts of RNA in the pool between each RNA sample). Sequencing analysis and base calling were carried out using the Illumina Pipeline, and sequence tags were obtained after purity filtering. The platform used is MGX (Montpellier, France). Data from each DGE library were analyzed with BIOTAG software (Skuldtech, Montpellier, France) for tag detection, tag counting and for assessing DGE library quality (Piquemal D, et al., Genomics. 2002 September; 80(3):361-71).

4. Tag Annotation and Selection:

A local database compiling *homo sapiens* sequences and related information from well-annotated sequences of UniGene clusters (Built#232, March 2012, NCBI) was generated. For each sequence of this database, the expected DGE tag (canonical tag) located upstream the 3'-nearest NIaIII restriction site (CATG) of the sequence (R1), as well as putative tags located in inner positions (labeled as R2, R3 and R4 starting from the 3' end of the transcript), were extracted (Piquemal D, et al., Genomics. 2002 September; 80(3):361-71). Experimental tags obtained from DGE libraries were matched and annotated (exact matches for the 17 bp) using this collection of virtual tags. Firstly, a correspondence for each experimental tag with the virtual canonical tags (R1) was looked for. Then, unmatched experimental tags with the R2 tags, then with R3, and R4 were annotated. The analyses of the DGE experiments were carried out using edgeR Method (version 2.6.9, Bioconductor).

5. cDNA Synthesis for Real-Time PCR:

Reverse transcriptions were carried out for each of the 119 RNA in 20 μl final reaction volume with 300 ng of total RNA using 200 units of SuperScript II enzyme (M-MLV RT Type, Invitrogen) and 250 ng of random primers according to manufacturer's instructions (25° C. for 10 min, 42° C. for 50 min, 70° C. for 15 min), the sameday with the same pipettor set and the same manipulator.

6. Real-Time PCR:

The validation of targeted genes was done on Real-Time PCR (qPCR) platform from Roche Diagnostics. The qPCR experiments were carried out using LightCycler® 1536 DNA Green Master Kit and RealTime ready DNA Probes Master Kit (Roche Diagnostics) on Roche Diagnostics LightCycler1536® qPCR apparatus according to manufacturer's instructions.

For Sybr Green assays, the reaction mixture was prepared in a final volume of 2 μl as follows: 0.4 μl of LightCycler 1536 DNA Green Master 5× (Roche), 0.1 μl of Bright Green 20× (Roche), 0.1 μl of Setup Control 20× (Roche), 0.04 μl of 50 μM primers couple (Eurogentec), 0.36 μL of DNAse RNAse free water and 1 μl of cDNA matrix (1/50 final dilution). For probes assays, the reaction mixture was prepared in a final volume of 2 μl as follows: 0.4 μl of Real Time Ready DNA Probe Master 5× (Roche), 0.1 μl of Control Setup 20×, 0.1 μl of 4 μM Forward primer (Eurogentec), 0.1 μl of 4 μM Reverse primer (Eurogentec), 0.1 μl of 4 μM FAM/TAMRA Probe (Eurogentec), 0.2 μl of DNAse RNAse free water and 1 μl of cDNA matrix (1/50 final dilution). All pipetting steps were carried out with Agilent Bravo Automated Liquid Handling Platform. PCR program consists in a first pre-incubation step at 95° C. for 1 min following by 50 PCR cycles (95° C. for 2 sec, 60° C. for 30 sec). To discriminate specific from non-specific products and primer dimers, a melting curve was obtained by gradual increase in temperature from 60 to 95° C. The qPCR data were analyzed using the Delta.Ct (DCt) method (Livak K J and Schmittgen T D. Methods. 2001 December; 25(4):402-8). The DCt values were determined for all target genes by subtracting the Ct values from the mean of the Ct values of the two reference genes (housekeeping). The two housekeeping genes were B2M (NM_009735, *Mus musculus* beta-2 microglobulin, mRNA) and GAPDH (NM_002046, glyceraldehyde-3-phosphate dehydrogenase, transcript variant 1, mRNA+NM_001256799 *Homo sapiens* glyceraldehyde-3-phosphate dehydrogenase, transcript variant 2, mRNA).

7. Transcriptomic Profiles:

Using the Digital Gene Expression (DGE) method, the transcriptomic profiles of total blood of patients was carried out and 169 genes have been selected with edgeR Method as genes differentially expressed between good- and bad-masitinib responders. The analyzed genes have been selected according to (i) mathematic filters with the highest differential Fold Change (>1.5), FDR adjusted p-value criterion (<10%) based on the type I ($\alpha$=5%) error and (ii) biological filters with involvement of targeted genes in specific processes and known metabolic pathways. In a real time PCR assay, a positive reaction is detected by accumulation of a fluorescent signal. The Ct (cycle threshold) is defined as the number of cycles required for the fluorescent signal to cross the threshold (i.e. exceeds background level). Ct values are inversely proportional to the amount of target nucleic acid in the sample (i.e. the lower the Ct value, the greater the amount of target nucleic acid in the sample).

Methodology for Identification of Gene Expression Predictor Factors of Overall Survival The objectives of this ancillary study were to reveal: (i) biomarkers predictive of extended survival (i.e. increased OS) for masitinib plus gemcitabine treated patients as compared with placebo plus gemcitabine treated patients; (ii) biomarkers predictive of early death (i.e. decreased OS) for masitinib plus gemcitabine treated patients as compared with placebo plus gemcitabine treated patients. This analysis simultaneously measured the expression level of large numbers of genes in peripheral blood cell samples collected prior to treatment with masitinib from 119 patients of study AB07012 (1:1 ratio of masitinib plus gemcitabine and placebo plus gemcitabine treated patients). The PAXgene™ Blood RNA System was used to collect a patient's blood sample and isolate RNA (ribonucleic acid), packed in dry-ice for shipping and stored at −80° C. The PAXgene tubes are FDA approved (i.d. K042613). Analyzed samples were taken once only at week 0 (baseline).

In general, differential gene expression presents several challenges in terms of reproducibility and detection of truly novel gene expression patterns. For example, analysis from Blood RNA samples is subject to various errors due to experimental and interindividual variability. Also, pre-selection of genes of interest could be hampered by the need of pre-existing knowledge of the transcriptome. The following measures were adopted by Skuldtech to address these problems and to ensure optimal reproducibility:

The usage of PAXgene™ Blood RNA collection system avoids degradation of the RNA and differences in sample quality due to different collection standards among sites.

Inherent gene-specific and interindividual expression variability were taken into account through edgeR Bioconductor analysis and pooling of RNA samples.

The DGE methodology does not rely on a pre-existing knowledge of the transcriptome of interest and can therefore be applied to any patient group of interest.

For the qPCR experiment, the current state of the art platform was used, which complies with industry and research standards.

The first analytical step involved a complete DGE analysis, performed using the methodology of edgeR [http://www.bioconductor.org/packages/2.9/bioc/html/edgeR.html]. In a second analytical step, a $2^{-ddCt}$ (2exp–Delta Delta Cycle Threshold) analysis was performed using R package ddCt on the Real-Time PCR experiment, [www.bioconductor.org/packages/2.9/bioc/html/ddCt.html]. This analysis was used to set the differential cut-off to assess if a selected gene will fulfill the classic clinical and technical properties. In this study, each gene of interest was amplified by qPCR and a resulting parameter named the Delta Cycle Threshold (DCt) was assessed after individual normalization for each gene and for each patient, thereby providing the expression level of a given gene in a given patient. Normalizing of Ct values was achieved using two reference (housekeeping) genes (B2M, GAPDH), which showed stable expression in the DGE analysis throughout the blood RNA samples. DCt are defined for each gene under investigation by subtracting the Cycle Threshold (Ct) values from the geometric mean of the Ct values of the reference genes. DCt values are inversely proportional to the level of gene expression; therefore, in the case of up-regulated genes a lower DCt value indicates a greater level of expression, whilst in the case of down-regulated genes a higher DCt value indicates a lower level of expression.

The DGE (Digital Gene Expression) method used in this study is a high throughput sequencing approach for transcriptomic analysis. This approach provides a digital measure of RNA abundance represented by the sequence read counts in a region of interest as opposed to an indirect, analog signal from microarrays. In addition, it has a broader dynamic range, and is not dependent on having pre-existing knowledge about the transcriptome under study. This approach therefore has the ability to comprehensively detect novel transcripts and mRNA variants resulting from alternative promoter usages, splice sites, and polyadenylation.

DGE libraries were generated with mRNA isolated using poly-A selection from total RNA. The subsequent construction of libraries was performed with Illumina's DGE Tag Profiling kit (San Diego, USA.) according to the manufacturer's protocol (version 2.1B). Briefly, the RNAs were randomly primed for reverse transcription followed by second-strand synthesis to create double-stranded cDNA fragments. Specific 21 bp-tags for each of the RNAs were then extracted. The tags were isolated, specific adaptors were ligated and then followed by PCR amplification. Libraries were sequenced by Illumina's DNA sequencing platform (San Diego, USA). Because DGE provides absolute values and does not require any calibration with arbitrary standards, results can be compared with other data generated by independent laboratories.

For discard biases due to human manipulations and heaviness of cell purification, Skuldtech opted for a direct read from whole blood. Hence, selection and identification of biomarkers with the DGE approach during the first steps of this project were performed on whole blood. Finally, a pooling strategy was implemented, a method frequently used in epidemiology when individual studies are too small to allow any definite conclusion. The main advantage of sample pooling is its ability to identify the most common/specific gene expression profile and discard individual variations.

RNAs were reverse transcribed according to the Roche Diagnostics' protocol. Gene expression levels of putative biomarkers were investigated by Real-Time PCR, using the LightCycler 480. Expression of reference genes was quantified in each Real-Time PCR plate in order to assess the technical efficiency of the Real-Time PCR experiments. Variations in Ct values associated to each Real-Time PCR experiment were evaluated among the reference genes. The DCt values were determined for all target genes by subtracting the Ct values from the geometric mean of the Ct values of the reference genes. Thus, a data matrix was constructed based upon the DCt values obtained from all Real-Time PCR dynamic arrays, which was subsequently used for all hypothesis tests.

Selection of Genes of Interest and Identification of Gene Expression Predictor Factors DGE analysis resulted in the selection of 169 genes, taken from a genomic database of 119 modified intent-to-treat patients. The selection of these genes was based on the impact of genes on overall survival, e.g. genes associated with a correlation of overall survival with masitinib plus gemcitabine treatment. Each of the selected genes was amplified by quantitative Polymerase Chain Reaction (qPCR) and the expression level of a given gene in a given patient was evaluated after individual normalization. Analysis was based upon variations in Ct values associated to each qPCR experiment with respect to a set of reference genes (B2M, GAPDH). Delta Ct values (DCt) were defined for each gene under investigation by subtracting the Ct values from the geometric mean of the Ct values of these reference genes. For each gene three cut-offs were specified: median, Q1 (first quartile, P25) and Q3 (third quartile, P75). For each cut-off (less than cut-off/more than cut-off) the multivariate model used for primary criteria calculated Hazard-Ratio, Chi-squared statistic and p-value of the Cox model (one per gene) in order to explain OS, used the factors of: treatment arm, tumor status, tumor localization, and albumin level at baseline.

Hence, for each gene seven different Cox models were run:

No cut-off raw DCt values in the model
DCt values<median
DCt values>median
DCt values<Q1
DCt values>Q1
DCt values<Q3
DCt values>Q3

If the effect of treatment arm was significant (p<5%) then it can be concluded that the gene under investigation has a different effect on survival depending on the treatment arm. The gene under investigation was selected for the next step if p<5%. A total of 37 genes/cut-off combinations were selected consisting of 17 different genes.

For each of the 17 genes selected from the above steps, the same multivariate model was used for each combination and each cut-off. Hence, for each gene seven different Cox models were run. The rule applied was that the subpopulation created by the combination should contain more than 40 patients (⅓ of the total sample):

These different combinations were classified according to the discriminatory power of the combination measured by p-value of the Chi-squared test provided in the Cox model. The six most significant (p-values<0.01) combinations are listed in Table 4.

TABLE 4

Selected dual-gene combinations of interest and cut-offs Population

| | | |
|---|---|---|
| (1) ACOX1 <= 3.05 | and | TNFRSF10B <= 6.1 |
| (2) RPS23 > 0.35 | and | ACOX1 <= 3.05 |
| (3) ABCC3 <= 4.3 | and | LYN <= 1.65 |
| (4) HIF1A <= 3.95 | and | TNFRSF10B <= 5.65 |
| (5) ABCC1 > 3.5 | and | IGJ > 7.05 |
| (6) UBE2H > 3.7 | and | PARP2 > 7.1 |

In order to finalize the most inclusive overall genetic fingerprint, the most significant dual-gene combination was chosen first and then the following information was recorded: number of patients in the subpopulation, Hazard Ratio; p-value of the Cox model. Next, another dual-gene combination was added in order to increase the sample size and also the power of analyses. The same information as above was recorded. The process of selection was stopped when no (or few) additional patients were added to the sample size following addition of a new combination, with the precondition that Hazard Ratio and/or p-value were maintained. Table 5 summarizes the selection process.

TABLE 5

Dual-gene combinations with statistically significant impact on OS with respect to treatment arm. Shown in bold are the most discriminatory dual-gene combinations corresponding to six gene expression predictor factors and collectively referred to as the 'genetic fingerprint' subpopulation.

| Population | | N | HR | p-value |
|---|---|---|---|---|
| (1) ACOX1 <= 3.05 | and TNFRSF10B <= 6.1 | 31 | 0.19 | <0.01 |
| (2) RPS23 > 0.35 | and ACOX1 <= 3.05 | 35 | 0.20 | <0.001 |
| (3) ABCC3 <= 4.3 | and LYN <= 1.65 | 37 | 0.19 | <0.001 |
| (4) HIF1A <= 3.95 | and TNFRSF10B <= 5.65 | 40 | 0.19 | <0.001 |
| (5) ABCC1 > 3.5 | and IGJ > 7.05 | 52 | 0.19 | <0.0001 |
| (6) UBE2H > 3.7 | and PARP2 > 7.1 | 56 | 0.192 | <0.00001 |

The process was stopped after six combinations. Among patients identified as harboring the GBM, some were flagged in both replicates (45 patients), some were flagged in duplicate 1 but not flagged in duplicate 2 (11 patients), some were flagged in duplicate 2 but not flagged in duplicate 1 (10 patients). Thus the final subpopulation comprises a total of 66 patients (=45+11+10). The final selection of dual-gene combinations constituting a set of "gene expression predictor factors" (collectively referred to as the "genetic fingerprint"). These gene expression predictor factors are: ACOX1<=3.05 and TNFRSF10B<=6.1; RPS23>0.35 and ACOX1<=3.05; ABCC3<=4.3 and LYN<=1.65; HIF1A<=3.95 and TNFRSF10B<=5.65; ABCC1>3.5 and IGJ>7.05; UBE2H>3.7 and PARP2>7.1

The DCt thresholds as defined above represent the most inclusive overall genetic fingerprint for distinguishing a target subpopulation. It is possible however, that optimal thresholds are found in proximity to these cut-offs, for example at 55% rather than the median. Furthermore, the thresholds as defined above are taken from a particular patient cohort (n=119) that can be considered as representative of a general cancer population, however, it should be expected that given a different cohort the optimal cut-offs will vary slightly as this is also just a representative sample of the overall population. Thus, for definition of cut-offs related to these gene expression predictor factors it shall be understood that slight modifications are encompassed herein; for example, ±10% of the stated cut-offs, or even ±25% of the stated cut-offs.

Taken together, these six gene expression predictor factors define a patient subpopulation that has a higher probability of positive therapeutic response to masitinib treatment in terms of extended survival. This subpopulation can be generally interpreted as the 'genetic fingerprint' subpopulation for masitinib treatment in cancer. Hence, all analyses (baseline, efficacy and safety) were performed on the 'genetic fingerprint' subpopulation (i.e. those patients identified as having at least one of the positive gene expression predictor factors). Additionally, efficacy analysis was also performed on the subpopulation that was negative for gene expression predictor factors (i.e. the 'non genetic fingerprint' subpopulation).

Assessing Clinical Efficacy of Study AB07012 According to Gene Expression Predictor Factors Considering the full cohort of patients with genomic information available (n=119; 60 masitinib and 59 placebo patients), the median OS was 7.7 months in both treatment arms and the hazard ratio for death was 0.89 [0.60; 1.31] with a p-value of 0.55. Therefore, no conclusions could be drawn regarding the beneficial or detrimental effects of masitinib treatment in this subpopulation without additional analyses according to gene expression.

OS was analyzed in the subpopulation identified as harboring at least one of the gene expression predictor factors, referred to hereafter as the "genetic fingerprint" or "transcriptional fingerprint" subpopulation (66 patients), and in its counterpart, i.e. patients that do not present any of the gene expression predictor factors, referred to hereafter as the "non genetic fingerprint" or "non transcriptional fingerprint" subpopulation (53 patients).

Table 6 shows the median OS and survival rate estimates as calculated via univariate and multivariate analyses for the 'genetic fingerprint' subpopulation according to treatment arm.

TABLE 6

| | | | | | | | | |
|---|---|---|---|---|---|---|---|---|
| OS results in 'genetic fingerprint' subpopulation | | | | | | | | |
| | | | Hazard ratio | Median OS | OS rates [95% CI] (%) | | | |
| Treatment arm | N | p-value* | [95% CI] | [95% CI] (months) | M6 | M12 | M18 | M24 |
| Univariate analysis | | | | | | | | |
| M + G | 34 | 0.0000019 | 0.22 [0.12; 0.40] | 11.7 [8.6; 17.1] | 78.8 [66.7; 93.2] | 48.6 [32.8; 74.8] | 15.8 [7.1; 45.4] | 10.6 [4.1; 39.0] |
| P + G | 32 | | | 5.3 | 36.7 | 7.5 | 0.7 | 0.3 |

TABLE 6-continued

OS results in 'genetic fingerprint' subpopulation

| Treatment arm | N | p-value* | Hazard ratio [95% CI] | Median OS [95% CI] (months) | OS rates [95% CI] (%) | | | |
|---|---|---|---|---|---|---|---|---|
| | | | | | M6 | M12 | M18 | M24 |
| | | | | [3.9; 8.6] | [21.7; 67.4] | [2.6; 35.8] | [0.1; 19.1] | [0.0; 16.3] |
| | | | | Multivariate analysis | | | | |
| M + G | 34 | 0.00000056 | 0.17 [0.09; 0.33] | 12.9 [8.7; 17.1] | 78.7 [67.5; 93.5] | 52.5 [38.0; 76.8] | 18.3 [9.1; 44.8] | 12.6 [5.7; 36.9] |
| P + G | 32 | | | 4.7 [3.7; 8.3] | 31.8 [19.0; 61.8] | 7.4 [3.1; 30.7] | 0.8 [0.1; 20.6] | 0.3 [0.0; 17.8] |

M + G: masitinib plus gemcitabine;
P + G: placebo plus gemcitabine;
NR: not reached;
*log-rank In the univariate model, patients in the masitinib plus gemcitabine treatment arm had a median OS of 11.7 months versus 5.3 months in patients receiving placebo plus gemcitabine.

This difference was even more pronounced in the multivariate model, with a median OS of 12.9 versus 4.7 months, respectively. After adjustment for differences in baseline characteristics, the difference in median OS proved to be statistically significant (p-value <0.00001) with a hazard ratio for death (defined as the probability of death under masitinib plus gemcitabine over the probability of death under placebo plus gemcitabine) of 0.22 with a 95% confidence interval of [0.12;0.40]. Thus, patients in the 'genetic fingerprint' subpopulation have a 78% decrease in risk of death when treated with the combination of masitinib plus gemcitabine as compared with gemcitabine alone. Considering a worst case scenario of the higher confidence interval boundary, i.e. 0.40, the risk of death for patients in the 'genetic fingerprint' subpopulation was still reduced by 60% when treated with masitinib plus gemcitabine. The Kaplan-Meier estimates for patients presenting with the 'genetic fingerprint' identified are shown in FIG. 7. The therapeutic advantage of the masitinib plus gemcitabine treatment over placebo plus gemcitabine is clearly seen in the multivariate model, in which the masitinib plus gemcitabine survival probability is consistently higher.

Table 7 shows the estimated median OS and survival rate for the 'non genetic fingerprint' subpopulation. Kaplan-Meier estimates for patients presenting without the 'genetic fingerprint' identified are shown in FIG. 8.

TABLE 7

OS results in 'non genetic fingerprint' subpopulation

| Treatment arm | N | p-value* | Hazard ratio [95% CI] | Median OS [95% CI] (months) | OS rates [95% CI] (%) | | | |
|---|---|---|---|---|---|---|---|---|
| | | | | | M6 | M12 | M18 | M24 |
| | | | | Univariate analysis | | | | |
| M + G | 26 | 0.0000082 | 5.00 [2.44; 10.25] | 4.8 [4.2; 14.4] | 40.0 [25.0; 76.3] | 10.8 [3.6; 53.0] | 3.3 [0.6; 42.1] | ≤0.1** [0.0; 35.9] |
| P + G | 27 | | | 14.4 [8.8; 23.3] | 81.0 [68.0; 97.0] | 53.0 [38.1; 86.8] | 34.7 [20.0; 73.3] | ≤9.3** [3.3; 46.2] |
| | | | | Multivariate analysis | | | | |
| M + G | 26 | 0.000036 | 4.24 [2.11; 8.52] | 5.6 [4.3; 11.5] | 45.2 [29.3; 76.2] | 12.5 [4.4; 46.3] | 3.6 [0.7; 30.5] | ≤0.1** [0.0; 20.4] |
| P + G | 27 | | | 13.2 [8.4; 23.0] | 79.6 [68.3; 96.6] | 53.8 [37.4; 85.0] | 33.0 [18.5; 70.2] | ≤6.9** [2.3; 38.1] |

M + G: masitinib plus gemcitabine;
P + G: placebo plus gemcitabine;
NR: not reached;
*log-rank In the univariate model, patients in the masitinib plus gemcitabine treatment arm had a median OS of 4.8 months as compared with 14.4 months in patients receiving placebo plus gemcitabine. In the multivariate model, the median OS was 5.6 and 13.2 months, respectively. The difference in median OS was statistically significant (p-value=0.00001) with a hazard ratio for death (defined as the probability of death under masitinib plus gemcitabine over the probability of death under placebo plus gemcitabine) of 4.24 with a 95% confidence interval of [2.11;8.52] in the multivariate model. Thus, the risk of death for patients not belonging to the 'genetic fingerprint' subpopulation, i.e. not harboring at least one gene expression predictor factor, is higher when treated with the combination of masitinib plus gemcitabine as compared with gemcitabine alone. Therefore, in the absence of any other positive predictor factor, said treatment of patients in the 'non genetic fingerprint' subpopulation is inadvisable.

Finally, it was noted that no correlation existed within the patient cohort with genomic data with their baseline VAS pain intensity status, i.e. with respect to the pain intensity predictor factor. This was true for the full genomic cohort (overall population), as well as for the 'genetic fingerprint' and 'non genetic fingerprint' subpopulations. In connection with the present invention, it would seem, without wishing to be bound by the theory, that this is due either to the parameter of pain intensity requiring a larger population sample size to be statistically distinguishable or because the predictor factors of pain intensity and gene expression act through independent mechanisms of disease progression. In this latter case, it is quite feasible for a given patient to be positive for one predictor factor but negative for another and for the treatment of masitinib to still be of therapeutic benefit; there is no apparent contradiction.

Thus, in the 'genetic fingerprint' subpopulation, accounting for approximately 55.5% of patients, median OS was 4.7 months with placebo plus gemcitabine, whereas it was 13.2 months in the 'non genetic fingerprint' subpopulation. Thus, to date, patients with the defined 'genetic fingerprint' at baseline are those with the worst prognosis in terms of overall survival when receiving the standard treatment for pancreatic cancer of gemcitabine monotherapy, and hence have the highest unmet medical need. Masitinib plus gemcitabine treatment significantly improved overall survival in the 'genetic fingerprint' subpopulation: median OS was 12.9 months as compared with 4.7 months in the placebo plus gemcitabine treatment arm (p-value=0.00000056). Overall survival rates at 12, 18 and 24 months were respectively, 52.5%, 18.3%, and 12.6% in patients receiving masitinib plus gemcitabine versus 7.4%, 0.8%, and 0.3% in patients treated with placebo plus gemcitabine. The hazard ratio was 0.17 (95% CI of [0.09;0.33]), suggesting that the risk for death was decreased by 83% for patients receiving masitinib plus gemcitabine as compared with the control treatment arm of placebo plus gemcitabine.

In conclusion, the above defined predictor factors of pain intensity and gene expression were shown to be independent factors for poor overall survival in cancer patients, and in particular pancreatic cancer in human patients, underscoring the high unmet medical need in the patient subpopulations of 'pain' and 'genetic fingerprint', as defined above. These two predictor factors identify patients who are suitable for treatment with the combination of at least one tyrosine kinase inhibitor, mast cell inhibitor or c-Kit inhibitor, especially masitinib or a pharmaceutically acceptable salt thereof, optionally combined with at least one antineoplastic agent.

SEQUENCE LISTING (55 sequences)

SEQ ID NO: 1 - DNA, 19 bp, artificial sequence
  probe
atggggaaggtgaaggtcg

SEQ ID NO: 2 - DNA, 22 bp, artificial sequence
  probe
ggggtcattgatggcaacaata

SEQ ID NO: 3 - DNA, 23 bp, artificial sequence
  probe
gctcagtaaagacacaaccatcc

SEQ ID NO: 4 - DNA, 21 bp, artificial sequence
  probe
catctgtggattcagcaaacc

SEQ ID NO: 5 - DNA, 19 bp, artificial sequence
  probe
ccagtggggatcggacaga

SEQ ID NO: 6 - DNA, 23 bp, artificial sequence
  probe
aggggatcatcgaagaggtaaat

SEQ ID NO: 7 - DNA, 20 bp, artificial sequence
  probe
tttcttcactgcagggcttt

SEQ ID NO: 8 - DNA, 20 bp, artificial sequence
  probe
ggaaaggagggattttgagc

SEQ ID NO: 9 - DNA, 20 bp, artificial sequence
  probe
ttttgctctttgtggttgga

SEQ ID NO: 10 - DNA, 21 bp, artificial seuqence
  probe
cctggtccacagaagatgttt

SEQ ID NO: 11 - DNA, 22 bp, artificial sequence
  probe
ggacataacagacttggaagca

SEQ ID NO: 12 - DNA, 24 bp, artificial sequence
  probe
tggcaatttcttacactaacctga

SEQ ID NO: 13 - DNA, 25 bp, artificial sequence
  probe
ggtttcatatttaatttggtcatgg

SEQ ID NO: 14 - DNA, 23 bp, artificial sequence
  probe
caaacaaggaagcacattgtgta

SEQ ID NO: 15 - DNA, 20 bp, artificial sequence
  probe
gatttggtcgcaaaggtcat

SEQ ID NO: 16 - DNA, 20 bp, artificial sequence
  probe
tgcctttgtatagggccaaa

SEQ ID NO: 17 - DNA, 21 bp, artificial sequence
  probe
ggaggacatttggtgggcttt

SEQ ID NO: 18 - DNA, 20 bp, artificial sequence
  probe
ccctctgagcactggaagtc

SEQ ID NO: 19 - DNA, 22 bp, artificial sequence
  probe
atccaacgtccaataaacagca

SEQ ID NO: 20 - DNA, 21 bp, artificial sequence
  probe
aaggctaccacaatgtctcct

SEQ ID NO: 21 - DNA, 22 bp, artificial sequence
  probe
gggaaaggaatctactttgctg

SEQ ID NO: 22 - DNA, 20 bp, artificial sequence
  probe
ttctttaggcgagaggcaaa

SEQ ID NO: 23 - DNA, 20 bp, artificial sequence
  probe
cgcaggttttccactcatct

SEQ ID NO: 24 - DNA, 19 bp, artificial sequence
  probe
atggccatttcttcccaag

SEQ ID NO: 25 - DNA, 44857 bp, homo sapiens
acagatttggaaagccgaccattatttcttcagaacaaggaacacattgtacagcccataatggccaacaatgagcaaaaagatctcctcctcagagtcatagtttgatagagaagtaagatgtcctttgcaaaaattgtatcagtgagagaattaggacagcgggggagagctgatctagccagtccccctcttgcctttggcctctaagctgcccttaattattcctggatttgggccaagctaactttgggagacatttagtttacagtttaaatgaaaatagcccttccctaaaacgcagccacctttgtaaagctaatgagaaaccaccaggctaggagcacagagaagcccgaactctgctaagattgccagccattattccaggggtcacaagctaggcaacttccccagttactcctgcagataacatcactattgcagaacctaagattggcctttggagatatcttttcaggttttttgcatgtctgacaccaacaactccacatggaccccacccaccactcctgcggcccccctcagaggtgactcagcctgcaggaggaccatttgccacacccctaaggttgcacccccaaccaatcagcagcaagcacccattgcctagctgccaccaccccttccccgaaactacatttaaataatgtctaatctctgagccttccagaagattgactaataataccaactcccacgtggtgtggccagccttgtgtcaattagtctttcttgactgtaatgccatgctctccatgaaatgatttcgtttgtgctgtgggaacccatcaggtggttatagaggtggcataggctatgaaaacactggttgtctaaaacagggggagataacaattatgaagggctagtgtacacgagtgtgtgctcactaacatgaggggactaaaggagtgtccccactagatgttcctgtttttctggtggatctggggaaaaagaggtggggaggatgctggggttgctatgcaattctcaccgagggaggaatttgctggtataatgattatacatttttctttctttctttctttcttttttgagatggagtctcgctctgtctgccaggctggagtgcagtggcgggatctcggctcactgtaaccactgcctcccgggttcaagcgattttcctgcctcagcctcctgagtagctgggaatacaggcgtgtgccaccatgcccggctaatttttgtatttttagtagagacggggtttcaccatgttggccaggctggtcatgaacttctgacctcaggtgatccacccacctcggcctcccagagtgttgggactacaggcgtgagacacctcaccgggcctcttccttttttctttcttttttttttttttgagccaaggcgggcagatcacttgaggtcaggagttcgagactagcctggccaatgtggtgacaccccgtctctactaaaaatacaaaaattagccaggcatgatggcgggtgcctgtaatcccagctacagggaaggctaaggcagcagaattgcttgaacccgggaggcggaggctgcagtgagccgagatcatgccactgcactccagcctgggcgacagagtgagactctgcctgaaaaaataataaataaataaataaataaaactatgatcaatgcttgagcctaagagtttgaggctgcagtgaactatggttgcgccactgcattctagtctgggtgacagagcaaggccttgtctcaaacaaaacaaaacaaagcaaaactatgatcaaatacatgtgtatgccttttctcctattaatcacttgtgtggtattcctgccaaaaatgcatcatctgaatctaatcatgaagaaatatcagacaaatctgaattaagggacattctactgtaggtgccaaggggccctctgaagtttcgctgcaaaaaatcaacttacaaaaggcagagtaatagtcaaaaatgtgtacaaatttatgtaacatgtacatatgggagccttcagaaggaagacccaaagatacaggggaaattgtacatttttatgcaaatgattgaacataaaaggtatgatctaatgctgatagactgagtggggaggcccagcaaggcctgtctgtctagattcttcttggcctcttggaacaggcattccttccttctgggtgtgggggaggaccctctctggaatggagtcttatggcctacagtcaaacaagctaggtcagataatttctttttggccagtttttacaccaaaagaaggagggaaagttaagagtaatatatttagggttttttttgtttgttttttgagacagagtctcactctgtcgcccaggctggaatgcagtggtgcaatctcggctcactgcaacctctgcctccccggttcaagcgattctcctgcctcagactcccgagtagccgggactacaggcacatggcacctcgctcggctttttttgtatttttagtagagacggggtttcaccgtgttagccaggatggtctcgatctcctgacctcgctatccacctgccttggcctcccaaagtgccaggattataggcgtgagccaccgcacccagcttatatttagggttttatggctggctttgggggtaaatgactctgttttctatgacctgccttggggaagaggattctaacttctctggctaggctcgggggagaatgcacctgagggagaggaggacagaaggtaaaaaaaaaaaaaaaaacaacttgctttgtgggttgcttctgaggccttcattttggggtattgttttctgagacccaacactacaaaacaatgggcttatacacttcaaaagtgttaatgtcagccagccaggcgcagtggctcacgcctgtaatctcagcactttggaaggctgaggcgagcggatcacatgaggccaggagttggagaccagcctggtcaacatagtgaaaccctgcctctaataaagacacaaaaattagccaagtgtggtagtacattcctgtagtcccagctactctggaggctgaggcatgagaatcatttgaacccaggaggcggaggttgcagtgagctgaaatcatgcaactgcactccagcctgggtgacagaggaagacatcatctcaaaagaaaaaaaaaaagcgttaaagtcacagaagaaaagttctttgttctattcttgtaattctcgtgtaaatttgaaattatttcaaaataaaaactcagcaaatttagctcttcatctaagtcttttctattcaatgctaagtacaccccttatcattgttacattaagagcaattggtttcctagaatattagaactagaaggtcagctgtcaagcagccatttgttcactccacaaagatttcctgagcacctttagcggggcaggcactgtgccaggtacagagaataaactagacaccctctctgctgttgaaggggcctgagatcagcagcttaataagacaaatgaggatcctgaggtcctaggggttaagagtgtgtattatagttctattattcaaattatgaatgttatgcatctctcgtagttttacttctgagaaaaccaaagtcatagtattacacagactacagacaggctaggcgcagcggctcacgcctgtaatcccggcgctttgggaggccgaggcaggtggatcaacaggtcaggaattcgagaccagcctggccaacatggcaaaatcctgtctctactaaaaatacaattagctgggtgtggtggcgagcccctataatcccagctactcgggaggctgagataggagaatcgcttgaacccagggggtggaggttgcaatgagctgagatcataccaccacactgcagcctgggcgacagagcgagactccgtctcaagaaaaaaaaaaaaaatgactagagatgattcaacaaatccctgaatctcccttgtctacaatcccactgggcagaactgtttttgttttttgttttttttctgtagagacagggtctcactatgttgcccaggatggagtgcaatgtcacaatcttggctcaccgcaacctccacctccggggctcaagccaccatcccatctcagccttcagagtagctgggactacaggcgcatgccactacacccagctaattttttggtattttttgtagggatggggttttgccatgttgcccaggctggtcttgaactcctgggctcaagtgatacgcccgcctcgtcctcccaaagtgctgggattccaggcgtgagccaccgcgcccggccctacactaggttttaacagtaagtgtgcatttcccactttgatgacggtgatggcgaaagcaaagaagtctggattccaagacctctagtaactgccaggttgcgggggaaaatgtctggtttcccagacagaaggcttagagcagcaccgcccgcttggtctcattctaagtccccgtccaccccttgaacagcgctcacaatcccacacccagggccccggaacccacgcctctgccagtaaagacgccattatcttaacaaaaggtaactggagcctctccccaaagagactggttcccgtcccattcttctccaatccgggtggatttggcaaaagcccaagtgaccctccctagcaattccgcaaagccccatctcccgccccagactccagagtctcccgaccactctcatttcggagaggcctaggggcacggacccggaagcgtgacagaggccgcggggtaagaggggggcaagtgcaggcgcaatccctcctcagcctcgttgtcccgcccccttcccaaggccccagccaacctgttctaggcgtcgccggtcctcggatttcttctttccgcctcgcgtggtcacgtgacgggggaggggcgggatacaaaaagtgctttattttcccactccccggacgcccagcagggcagtttcttgaccttcggagcccctttcccgaggatccgctcgggagcctcccctggccaggagcaggggattagtctgccccgcgaccggccccagccacgacgcggacatcgccccctctgtctgggccgctgtcactcacgcgccaaagggccacggagaaagaaggggcgggccggggcgggccgggcgagcggaggcggggacttgcgccgtcctgaggctgcctcctagggtccggccggcgctggagctgcggatttagattgtcactgccacctcggtcggtgcttacttcgctgccagctggtcgtcgccatgaacccggacctgcgcagggagcgggattccgccagcttcaacccggagctgcttacacacatcctggacggcagccccgagaaaacccggcgccgccgagagatcggtgagggcggcgggcgagacctccctcctttcccgagaaaagctggagactccctcgatgcggagtcaggggcgctgtggggcctaggccctctggcccagcgttaggggagccgggacccccacttcgaggaacagcctgtgtccctggtggggggatatcgccattccccaggtgtgtccgcgactctgaagcctattgtgattcagggagggtggaacggaggcccgagtgtctgtctgccttttaatgccctttaaccccctttcagagaacatgatcctgaacgacccagacttccagcatgaggacttgaacttcctcactcgcagccagcgttatgaggtggctgtcaggaaaagtgccatcatggtgaagaagatgagggagtttggcatcgctgaccctgatgaaattatgtggtttaaaaagtaggtatgccttagaacagagcaagtgttgttaagcctaaactttacagctgcggtctatggtggcctttcatcaccgtgcttggtgtttgaagatgcaaactggcatattttcatgcaactttataaagttatatgtgtggccgggcgcggtggctcacgcctgtaatcccagcactttgggaggccgaggcgggcggatcaccaagtcaggagatcgagaccattctggctaacacggtgaaaccccatctctactgaaaatacaaaaattagccgggcgtggtggcgggcgcctgtagttccagctactcgggaggctgaggcaggagaatagcgtgaactagggaggcggagcttgcagtgagccgagatcgcgccactgcactccagcctgggcaagagtgcgagactccatctcaaaaaataaataaataaataaataaataaagttatatgtgtgaaaaataatgtgatcacttttgtatccaagccttttcgtgggatgacgtgtttgtagaatgctgataataaatggaaatgcaggagtttttgttctcaagagtacagtttcaaggatgttgtaaaagcattgttctgcccaagcaactcaaatttgactgatttaaatgcagaatcattttgctctttgtaaggaggactgctaaaattctgaatctgggagcatttttttttttagttgcacgaccatttaaatattttggagcaatagcagattatattatatggtagtgtggacctggatgaagaatgatctgtgacgcctctgaatgaatagaaagtctaagaacccagtagttctgaatccatgacagtgcttgaatggttgtcttgtgcatatgagagagacgtcataaaaacctgccttggttctagtgtggaagagagtatatccttttttcagaccatgtgttttgttgtgttttttgtttttgtttttgttttttgagacggagtctcgctctgtcgcccaggctgcagtgcagtggcacgatctcggctcactccagcctccacctcccggattcaagcgattctcctgcttcagcctcctgagtagctgggattacaggcgcccgccaccacacccggctaatttttgtatttttagtagagatggggtttcgccatgttgccaggctggtctcaaactcctcacctcgtgatccaccctgctccacaaggaacggtaaaaataaataaaaataaggacttcgggccgggcacagtggctcatgcctgtaatctcagcactttgggaagccaaggcaggtggatcacttgaggccaggagctcgagaccagcctggccaaaatggtgaaactctctctactaaaaatacaaaaattagccgggcctggtggtgcgcttctggggtcccagctattcaggaggctgaggcaggagaatcccttgaacctgggaggcaaaggctgcactgagccgagatcacgccactgcactccagactgggcaacaaagagagactctgtctcaaaaaaaaaaaaaaaaaaaaaaaagacttttttgccttaacctaaacaaacactattacatgatcctagtacaagattattttggcctatagcatttttttctcatttattcctgggcattttctcttttaggtttctccattttaaaggaactccagtattttcatcggtaaagactaaatcgtatgagtggtgtatagactagaaccaagctaaatagaacatgttgcacgttctgcctttatggtaataatggtcactgcctctagtgcctttggtatcgattttcagcttgacttgggttatttttgtgaagatgaaatggtttactctggcactttggactttcctcagagctccactcagttttaaacgaaaaaattttgtttatttatttttggtagttcaaatcagcatacttccaaatggtctgttttgtttttgaagtttgtaactcatggctgtggggatattgagatagagtaactcctcctagaagattatgttactgatacctgtgttgtgtttgtaaatttgaaaaaattagtaagattttattccttcttgaaacgtcaggaaaaaagtgggttgagtgtgtgtgtgtgtgtttgaatgggtggtgcagtgcatttcaaagctgatagagatgatttcataacctgtgacctgttgataatgtgaaccagactcgagtgaggtcacaatgaaatagaacaaagtcttttatgcgggttaaagattcatggacaccgggaagttgttttgtgtatcatttttcatgtgaagtattaaagtacaaactttaacacaccctttgacacacttccaatgtccttaggatatgacaaggagatcagtttttaagtaagagaaggggtttgtaaatgagtcctggaaattatcgcatgctatcgagttaaagcctcggttatataatctcatcgattataactcacaccagtgttttgtgtaccactaagaaagaaagaatgctgccagttaaccgtgacatgctattaattgtgaaatacatcacctttctttcttttcttttctttctttctttcttttcttttctttcttttcctttctttttctttctctttctcttcctctttctttttctttctctctctttctttctctctctctctctctctctgcatttccatttatttccattatcagcaggtgaagaggcatctgccacctcacccagctaacttttgtatttttagtagaaatggggtttcaccatgttggccaggctggtctcgaactcctggccttgtgatccacccgccccttcctcccaaaatgctgggattacaggcataagccactgcgcctggctgagaaaacatttttaactgatgttaatgagcagcttctaaacacatgattaggacgcagaagtcgttccctctggtggaatctataatgattacattaattcattttgattaattagaaatattcgtatctaagagcatccatgttgagagttttttgtttctaagtggattatgatttatgtaagatagaaaagacaatgggactggggcatggtggctcacgcctgtaatcccagcactttgggtggctgaggtgggcagatcacttgaggccaggccacttcatgaccagcctggccaacatggcaaaacgccttctctactaaaatacaaaattaaccgggcttggtggcacacgcctataatcccagctacttgggaggctgaggcatgagaatcacttgaacctaggaggcagaggttgccgtgagctgggatcacaccactgtactccagcctgggcaacagagggagactgtctccaaaaaagaaaaaaaaagaaatggcggggataaccgtgtagtacttatttaggaaatagaaaaataagggtatattgtgtttactattatttctttctttctttctttttttttttttttttttttttggagacagagtctcgctctgtcgcccaggctggagtgcagtggtgcgatctcggctcactacaagctccgcctcccgggttcacgccattctcccgcctcagcctcctgagtagctgggactacaggagcccaccaccacacccggctaattttttttttgtatttttcgtagagacggggtttcaccatgttagccaggatggtctcgatctgatggtctcgatctcctgacctcgtgatccacccgccttggcctcccaacgtgctgggattacaggcgtgagccaccgcgcccggctactattatttcttttaaggtggtagtttggtttcagggtcccccagcactgcaatggcagcctatcccttctgtcctttagttcatgctctgctcattgcacaggttaggataaactggtagtaacattgcttcctaatcatgtgttgagaagtcgtgaagatcagttagatgagatgtattttgtactttaaactttttagatacgagctttgtcaaagtacaaaattgatccctataaaatctatgacacagcacagccaaggccaactactgtggattctgttttgtaagaagagagttgaggactaaatttcaatgtgatgtagagttaatccgtagtaatgttcattgaccattggggataaatttttacatgcccacattacttattgtaaaccctgaagacctttagcgatgtatgattctgccctggaatatgtatttactcttttggatatttgcttatattatctagggaaacatagttgaaattatttcttccttggagctcttgttaacagcgctataaataagtgttctatggagttatttttgctctttgaaacaaacaggtaaaacctaaataaagcaaaaaaaaaaaaccacacacattctaaaaaattcaaccaatcaaaccagcaaataacaccaacaacctccccttccaaaaattagagaagtttttatgctaaaacttaggtagaatttgcttagtggattaaatgtaaatacgaaatgaactgtgggaactgtggccttgaaataattagaagaagagagatcatcaggttctgctgctggctttttaggtagtaaaatggtaaatcttatatttaatttcataagaagggggtttacattttcctgaccttctccttgaaggccaaagctgtttggcaagaaggggttgtaggatgcagtttctaaaggaaggctgagatccttttctcttctctcctgtagactacatttggtcaattttgtggaacctgtgggcctcaattactccatgtttattcctaccttgctgaatcagggcaccactgctcagaaagagaaatggctgctttcatccaaaggactccagataattggcacctacgcccagacggaaatgggccacggttagtccacattgagggtctgtgggtaacccacctcaggacatcagttaacagtgattgctggcatttgacttttttctgctgctacctgtttgggattctatttttaagttgttaagtcaaaattcaacttcttgttttctcctagacattttccctggaaactggtccagggctctggcctataaacgtcattcactgttatttcctaaagccttttattattgaacagcttgaaaagatggggtttacagtgcagcggggaaccccattatgttactctgggtctaatgagtaaagactttgttggaaattcttcagagggttagtgcctcagcaatatctggaaagcgcctctctgctctaatgcagttaaagctgtggattttaatgggggcagcaggcagtggcagctacctgtctcatctcattgcccactagcagggttataaggcagtttggaaaaaagtccatgattctcttcatctgacttcagtctttttagacattttttcccctacatgtctgggaactcttgtgttgccagtaattctttgttaaattgttcctaaatatctggcttccttcaaaaagttttgcttttgatcttaatgtgaaataggtttgttttcatagacaaggccattggcaggtttgagtgtttggaatttgaactgcccagcctcatgtctaattatcaaaatggcaggagtaaagaaagggaaagaaaaagggatgcagatatcagggaaacatcattttgtgtttgattgctgatttcagtgtgtgaattggtttaaggaaaatgttatttattgtcatctccatgggtactgcagctttctggtcatggtttgatgttccagacactttactaaacactcaagacttcaacttcaagatggtcagtactgaaattataagcctgaaagaaaggtttgtaaaggaagataagattcttttttttttttttttttttgagacagagttttgctttttttgcccaggctggagtgcaatggcatgatctcagctcactgcaacctccgcctctgggttcaagtgactctcctgcccgagcctcccgagtagctggaattacaggtgctcaccaccacgcccggctgattttgtatttttagtagagacgtggtttctccatgttggccaggctggtctttaactcctgacctcaggtgatctgtccaccttggcttcccaaagtgctgggattacaggctacaggcgtgagccaccgcgcctggctgacagatccttcctttttttttttttttttggagacagagtctcactctgtcgcccaggctggagtgcagttgtgccatctcggctcggtgcaagctccgcctcctgggttcacgccattctcctgcctcagctcctcagtagctgggactacaggtgcccgccaccacgcccggctaattttttgtattttagtagagacggggtttcaccgtgtaagccaggatggtcttgatctcctgacctcgtgatctgccctcccaaagtcctgggattacaaggcatgagccactgcacccggcctgagagataagattctttatgtagtcctcctcgcttggagtatctgtgtgtttgtgtacatgcatgcgtggtgtgtgtgtgtgttgtaattttgaagtagctttgtggtacagaactctgtttcagtattcatcattatagaatttattcgacttaacagtcatgctgttcataggaggcataagatgtgaaatagtctgaggctaatggatttgttaagtatacctcttacctcttgttggtctaatgcttctgcctcatttataaagtaatatcacaaatatatatttgccctaatttttttttttttttttgagtcagagtctcatcctgtgccccaggctgaagtgcagtggagtgatctcagctcactgcaacctccacctcctgggttcaagggattctcctgcctcagcctcctgagtagctgggattacaggcacctgccaccatgcccggctaattttgttatttttagtagagatggggtttggccattttggccaggctggtctcaaactccttacctcaggtgatccacctgtctcagcctcccaaagtgctgggattacaggtgtgagtcaccacgcccggcctgccctaatttttgaaaggagagaggaagaaaggaagacttgaactatactggtttgaggcaaacagaagttggacagagatcctatatggctgtgggcaagtttgcatttgttagagttttcgttcccttattgcttttagttttgggtatttttttttttttttttgagacagagttttgctcttgttgcccaggctggagtgcaatggcgcgatctcggctccccgcaacctccgcctcccaggttcaagtgattctcctgcctctccctccctagtagctgggattagaggcgtgtgccaccatgcccggctaattttgtattttcagtagagacggggtttctccatgttggtcaggctggtctcgaactcccgaccttaggtgatctgcccgcctcggcctcccaaagtgctgggattataggcgtgagccatcatgcccagctagttttgggtattttcttgtatttaaaccaacgttgtcttaatctctgtggtttagagaacagtgtcctaagattagtcttttttcttgctggaattttgctaattcatattgctgttcttggttgatgactgatcttttccttggaaataagtcaggttggttaatttgcatcacgtgacggttttatcttatatggaatacacaaaaagtcaacgtccaggagatcggcaatagagcagcttatatagaatgagatctaactatttaaattctgagactttggaaaatggatcaacagtgaacagtgattatctaacgcggtctcacagaagtagctgtaactttgggtttgggattctttcacttctgggtagctgctgagaagtgaaggggctcagaagtattcaggttcactccatgttccttccaaatcctaaaattcagtcacctacagaaagtctcagtcaccagcattatccttctttctagagtgtgtcttctttcctctaaggacacgaagaaactcggatatacacctgccctgtgggtctgggagccataatcaaaggcagaggcctgaacctgggtgataggctcacctccctggagttctgggatcaaaggaacagcctggggaactgggtccatgttatcatcctgaccatatgtttctttaggccacaaaacaggtcgtttgtttgctcttcacagatatgtaatcatttcaagatgtggccatttctggagattcttcttgctttgttttccttgtttgcttgcttgctcacttccttccttccttcctctttttttttttttttttgaaggagtctcatgttgcccaagctggagtggtgcaatggtacaatctcggctcactgcaacctccacctccccctggttgaagtgattctcctgcctcagcctcctgagtagctgggatcacaggtgtgcaccaccatacctggctaatatttatatttttagtagagacagggtttcaccatgttggccaggctggtcttgaactcctgacctcaggcgatctgcccacctcggcctcccaaagtgctgggattagaagtgtaagccactgcacccggcctctttctcgctctctttctgtcttcttcccttcctccattcctttcgttcctttctttctttattcctcacccatggactggggtcacattgccttgtttcgtattaccatctatttaggaatatagagattgtatgatacatagttatccttgaagctgatgcagtatcctggcaaattgccatcattaacacttaaatatgaaataatgcacctttctttgaaactggaaagaggtagtaaacttgatttttaagtcatcagtctttaccgcactccgttgccctctctccctaggcttaacagtctcctcttccctctgcccaagtgattctcttccctgttggacttctcatgagacttgcttccctggggatttgggctaaatttcaccaatattagtgataataatataaactttatgaaagctgtgttctggccaggcacggtggctcacgcctgtaatcccagcactttgggaggccagcgtgggtggatcacctgaggtcgggagttcgagaccagcctgaccaacatggagaaaccccgtccgtactaaaaatacaaaattacctgggtgtgatggtgcgtgcctgtaatcccagctactagggaggctgaggcaggagaagcttttgaacctgggaggtggaagttgtggtgagctgagattgcgccattgcgctctagcctgggtaacaacagtgagactccgtctcaaaaaataaataaataaataaataaataagacgctgtattctttggggtcatacttctggaatacctctcagaaatgaattactatattgagggacatgagcattttagagcttttgctgcatagtttgaggcttttcctgaaacacagaaccagttgacaatatattgagcaagctctgtacctgtatttccacagctccatcaacgtggtcactttaatttattttgctactttaacatatttctttttttttttttttgagacggagttttgctcttgttgctcaggctggagtgcagtggcgtgatctcggctcaccgcaacttccgcctcccgcattcaagcgattctcctccctcggcctcctgagtagctgggattacaggcatgcgccaccacgcccggctacttttgtatttttagtagagacggggtttctccatgttggtcaggctggtcttgaactcctgacctcaggtgatccgcccgcttcagcctcccaaagtgctgggattacaggcatgagccactgcacatggcctactttaatatatttctttttttttttttttttttcaggcggagtctcgctttgtcgcccaggctggagtgcagtggcatgatctccgctcgctgcaagctccgcctcctgggttcacgctattctcctgcctcagccccctgagtagctggtactactggcaccctccaccatgcccggctaacttttttttttttttttttttgagacggagtctcgctctgtcgcccaggctggagtgcagtggcgggatctcggctcactgcaagctccacctcccgggttcacgccattctcctgcctcagcctcccaagtagctgggactacaggcgcccgccactacgcccggctaattttttgtatttttagtagagacggggtttcaccgttttagccaggatggtctcgatctcctgacctcgtgatccgcccgcctcggcctcccaaagtgctgggattacaggcgtgagccactgcacttggcctactttaatatatttctaacacttaatgttttaatttcccattactagtaagcctggatgttattacgtgttttgatttactgtttgtgttttctatgtataaaatacggttttttggctgggtgcaatggctctcgcctgtaatcccagcactttgggaggccgaagtgggtggatcacttgagatcaggagtttgagaccagtctggccaacatggtgaaacctgtctgtactaaaaatctaaaaattagctgggagtggtggcggcacctgtaattctagctactcggaaggctgaagcaggagaatcgcttgaacctgggaggtggaggttgcagtgagccgagatcgtgccactgcactccagcctgggtgacagagtgacatgctgtctcaaaaaatatatatatatatacgtgtatatatatatatgtgtatatatatatgtatatatatgtatgtatatatatacgtatatatatgtatatatatgtatgtatatatatacgtatatatatgtatgtatatatatatgtatgtatatatatatatatttcgattttttaaattattttctgctttgctaaacgtttttgctttatatatttaacacatccttctctgcataggtataaattttatcttttccataacttggatagttttcttctgggtttttttttttgagacatagtcttcctctgtcaccaggctggagtgcagtggcatcatcttggctcactgtaacctctgcctcctgggttcaaagccattctcctggctcagcctcccgagtagctgggatcacaggtgcccaccaccacacccagctaatttttgtatttttagtagagatggggtttcaccatgttggtcaggatggtctcgatctcctgaccttgtgatccacccgcctcggtctcccaaagtgctaggattacaggcgtgagccaccacgcccggcctcttctgttttcttctaatatttttgtttggtttctgtttaatgatttgacttgtatatgatacagagtgagaatgaatctcatggttttctagattttttttttttgtacttcttttttcttttttttgagagacaagagtctcactctgtcacccaggctggggtgcagtggcgcagcttccgagatttctaatgttcattgttaactagtggctttttcccattattatcttattcccattatgtcctttctggtttgtcttagagttttataataggttaaatttatttctggaaccttaaatatattacattgataggtttatttctttctttgtttttcttctaacataaattttgaccactggtgctttataaaatttttttgagacagaatctcgcactgtcacctgggctggagtgcagtggcgcagtcatggctcactgcaacctctgcctcctggattcaagcgattctacctcagcctccccagtagctggaattacaggtgcctgccaccacgcccagctaattttttgtatttttagtagagacgaggtttcaccatgttggccaggctggtctcaaactcctgacctcgtgattcacccacctcggcctcccagaatgctgggattacaggcgtgagccaccgtgcccagccaagactttttactctatttttatttttattttttatttttttattttaattttttatttatttttaagacggagtcttgctctgttgcccaggctggagtgcaatggtgtgatttcagctgcctgcaacctccgcctcccgggttcaagcgattctcctgcctcagccccctgagtagctgggattacaggcgtgcaccaccatgctcagctaatgtttatatttttagtagaaacggagtttcaccatgttggtcaggctggtctcaaactcctgaccccgtgatccacccacctcagcctcccaaagtgctgggattacaggcacgagccaccgcacctggcctttattttttattttattatttttatttattattttttttctttttcgagatggagtcttgctctgtcacccagcctggagtgcagtggcatgatctcagctccctgcaacctctgcctcccaggttcaagcaattcttctgccttagcctcccgagtagctgggattacaggcatgtgctaccatgcccatctaatttttgtatttttagtagagatggggtttcaccatgttggccaggctggtctcgaactcttgacctcaggtgatctgcctgcctcagcctcccgaagtgctgggattacaggagtgagccactgggcctggcatatttttatttttgaaagacgggttcttgctctgctgcccaggctggagtgcagaggtttgatcatagctcactgcagccttgatctcctagactgaagggatcctcctgcctcagtctcccgagtagttgagagtatgggctcgtgacaccgcgcccagttgattttttaaatttttagtagagataggatcttgctgtgttgcccaggcttgtaaggtatttaaaaatctgataggataagcctactgttgttacatttcaagatacgtgtatttggtatttaagcttgcttattctagatgaattctgatctgaatctgtcaggttctaaaaaaaaattctacaggaattaaatgtgtttttctccttctctatctggaattttaagttagttttatattgaagccttgtcttttcttgggaagctatttctttcctgttatttttatctttttttcccaccctattaggtatttatcttttttctgggttttttttttttttttttgagacagagtctcgctctgtcgcccaggctggagtgcagtggggcgatctcggctcactgccagctccgcctcctgggttcacgccattctcctgcctcagcctcccgagtagctgggactacaggcgcccgccaccacacccggctaattttcttgtatttttagtagagatggggtttcgccgtgttagccaggatggtctcaatctcctgacctcgtgatgcgccctcctcggcctctcaaagtgctggtattaacaggtgtgagccaccacgcctgagtgctgttaattttttttcccttatagcctgcagcttttctcaattcacttattgtggtattttgttgacattattgatttcctaggatgatactcatgctttctacagagctgctttttatttcttcctttctcatatatgattagtctaattggtttttcctcagtattgattgtcagcctttccagccttgtatcatgtggaaagagaggctggggatgccttttgatgttttggttttaaaagagctgactctagcccttcactaagtataatgttggtgcttcgtaattttacgataaattatttaaaaataatatctttatcatgcataagcagcttttaaaacaaatacttggcttaagtcaaaaaactatgcagttcactttctccttgtaacatttctaaatttcatccacatctgaataatccttgtcttatttggaagaaatatttttttcctgaaaacattctttagtgtcagaaccatttgtgattatagtggttttacccctgccctactgagcgcatttgttgtaacccttagcgtgcatcttcactctgtggtacactcagatgtaaatcttccagaggctgatgggtgcttgatagtggcctttccttcaccaggaattgctctgatttctagtgaagtaaaataaccttccataaaagcatgaaaagtgtctggtcccaggtttcagtcctaactcagttttcaccttccaggttctaagtgcacattgaattttcttcctagacagtactcaaaaggctggggacagttgacatttctgtttgagtgaaaggcactctcatcccatgaatgtgtttttcttgggatttccgctattaatttttttttttttttttttttgagatggagtcttgtcccccaggctagaatgcagtggtgcgatcttggctcactgcaacctctgcctcccaggttcaagcaattctcgtgcctcaccctcctgagtagctgggataaccagcgcctgccaccatgcccagctaatttttgtatttttagtagagatggggtttcaccatgttgcccaggctggtctcgaactcctgacctcaagtgatccgcccaccttggccccccaaagtactgggattataggcatgagccaccgtgcctggcctttttttttttttaattttgaaatgattgtagagtcataggaagttacaaaaatagtaccaggaaaccctgtgaacccgtcacggagtctctaccagtggtgacaccttgtgggatttccatttttgaggcttctaaggacagccctggctttttcagcatgtctttttagcatcttcattacagtcacagtctttttttttttttagatagagtcttgctctgttgccaggctggagttcagtggcacgatctccgttcactgcagcctccgcctcccgggttcaaggattcttctaccccagcctcccgagtagctgggattagaggctggcgctgccacacctggctaatttttgtatttttagtagagaggggtttcaccttgttggccaggatggtctcgatctcctgatctcatgatccgcccaccttggcctcccaaagtgctgggattacaggtgtgagccaccgcgcccggcctgcagtcacagtctttagtccatgctatgcttgtgcagtaatttccccagctaggagacaggacgaggtgacaaggtggttctttttttaaaaaataggtttagggggtacaagtgccatttccttacatgtatatattatgtaatggtgaagtctgggattttgcagtacccattgcccaaatagtgaacatagtacccagtaggtaacttttcaggcctcatacccctcccatccttccacattctggagcctccagtgtctgttttgttcgttgttgttttttgtttttcgagacagagtctctgtcgcccaggctggagtgcagtggtgccatcgtggctcactgcaacctttgcctcctgggttcaagtgattctcctgcctcagcctcccaagtagctgggattacaggtacccaccaccacgcccagctagtttttgtatttttagtagagatggggtttcaccctgttgaccaggctggtcttgaactccaacctcaggtgatccccctgcctcggcctcccaaagtgctgggattacaggcgtgagccaccgcgcctggcccctgtgtctgttactccattctgcatgtccatgttttaccccttgctcagctcccatggtgacgagattcttgtccttgttttgccattttcttttttccctgagcaaggcatttaattcatctcagccttaatttctcctctgtaaaatgagggattcagtcacacatactttgatttttctttttctaaagtgtgattgcttagctgaaagcctagccactagattggaagaagtcattgattagcacttgtctgagcagtgtgccctggttcttttcctccctaccttgcaaggaacaaacagcaatttaaaaactgaactgtcatttatgctcatttcaaagacacatagaatgataagagcaatatggagttgacggatttggagctggcaattacacagaataccagtaatgtggaaaaatgcaaaggcctatagaacgacttcctatccctagcaaaaattcacacagaatcctgtcccctgcacgttttaagtggaaaagaatgaccccagaaagttgatttaaaactaataaagctgtttattatcattaatgataatttctgtataattgtcacggagagcttatgcatgaatctgtaacttgtcgttattatggtcttcactagaaattgcatgtcttttttaatttctgaaataaattattgggatgaagagcactgtcagtttttgtattaaagtgtttcagtagagcgtggccgaatatttgacatgatgaatctgaatgaaatgatcagagctatgtgaggaatatggttctacgctggatgttttgtggacaaaacagaaaaaaaatcccagcctagaagcattattgaaattgcatcgaggaaaaactataatctgggggtcatactgtcactctgagagaactactatgttctgtctcgctttctcatcagaggaaatccttgtaccagtaccactcaaattctctgttctccgactcctggcttcaagcgattctgcctcagcatcccaagtagctgggattacaggcacatgccaccacacccagcaaattctccattctatacaactttttttttttttttttttttttgagacagagtctcgctctgttgcccaggctggagtgcagtggtgtgatctcggctcactgcaaccaccgcctcccaggttctcctgcctcagtctcccaagtagcttggattacaggcatgtgccaccacacctggctgattttgtatatttagtagagatggggtctcaccatgttggtcaggctggtcttgaactcctgacctcaggtgatccgcccaccttggcctctcaaagtgctgggattacaggcatgagccacggtgcccggccttttttttttttttttttttttgtatttttagtagaaacgggatttcactatgttggccaggctggtctcaaactcctgacctcaagtgatccgcctgcgtcagcctcccaaagtgctaggattacaggcatgagccaccatgcctggccctatacaacttttcaaattctctctctctttttttttttttttttgagatggagtctcactgtgtcgcccaggctagaatgcagtggtgttatcttagctcactgcaacctctgcctcctgggttggagcaattctcctgcctcagcctcctgagtagctgggattacaggtgtgcaccaccatgcctgcttaatttttgtatttttagtagagacagggtttcgccatgttggccaggctggtcttgaactcctgacctcaggtgatccacccacctcggcctctcagagtgctgagattataggtgggagccactgcacctggccaattctctcttatttatttatttattttttttgagacagagtctcactctgtcacccaggctggaatgcagtgggcatgatctcggctcactgcaacctccgcctcctaggttcaagcgattttcctgcctcaggctcccaaatagctgggactactggctggcgccaccacgttcagctgatttttgtatttttagtagagtcagggctttgccatgttggccaggctggtctcgaactcctgacttaaggtgatctgaccgccttggcctcccaaagtgctgagattgtaggcatgatccactgcactggcctctcaaattttctttatttcctttgatttaattcctgggcgaggatcctctgccttgcacgtgtggttttgtgctgcattggctttggaatcagtaaccaatccctgtcctcgtactccttgccgactcaggaaaaatggaaattaacaagagctataaagtaatacagaaagggacagtgctcccatctatgattaagtgcacgcaactaattcatacttaaggtttttttgtctccttcccttgctctatttaaattgctgattctctcacacctgatgactcttctctcaaatgcccatccttgatatttcctcgaagttttgtgcaccgagggcggcctgagcctctggatcttcacttgggcatgttcctgcccaccttgcttcaccaggcaactgcggagcagcaggagcgcttcttcatgcccgcctggaacttggagatcattggcacttatgcccagacagagatgggtcatggtatggagtattcagtctaccttctgggttgggcgggcccctgtgagcttaccatgtgtggagtgcccaccatgtgccatcgatggtgtgtcgatgttctatggtctgtttaaatgagctctttctgcagagtccaggttttggtataaacactgctttggtgagtgggaattaaagaccatgatactgataaaatgattgtcctttttataccatagttccccttcagagggtcaagaattgcaaatcaggccttatttaccaagtggtttttcaatgttactgaggttgtatagaatctgtgtgcatatacaacccgaagctgtttttttcttcattactatctgattacctttactactgataccttaatgagtacaaattccagaagaaatacaaataatagtttgtgtactcttggatttgcttgagggaaatgagtagcttataactgacgtgtgtgacattttggagttatttgtactttgagtcaatcagtagttctgcaagtgacttggctggagagtgaaaaaaccaagataagccgaacttgcaggcatttggtttcagactctgtatctccacctttcattgatctttccaccccccacctgctttcttcatgcacctgggtgggctggaggtggccgctgttcctctttgtatcttctctgaattgggtccgtgtttgccattcatttgcttatggcttctctttttctgctctgacgtttcagaaaaactggtctagtgtgtatttgccacttgctccttatttctatacagctgctgctttttatttggtgttgaatagtattttacaggattttcatgagactccaagtggaatactatttgtttcagttgtgcttttgaaaacattttgtccttatctgttctgtttaatgttatctgcttttctgtaaaagctgcttctttgatgaaagatgtctgtgtctgatttgttgactcccactcgggaaagttgtggattgcacataagttggttattcaacttggaagcttctaaatgtttcaaagtgtgtttaatgaggtctaagcgttatgaaagcagattggtaaaaggttcccaacgtttgctttagtacagtatttttgtagagactgccacctagaacatttttctatgactcttttcaaataattttgatatatttgtgttaagatttaaaacataagatcctgtctatcccagtacacataagaaactggaaactcttccttgccacattaatgaaccagcaggactaagttaggcctgccattggaaatctctagggtcaactgagaccttattattggacctttaggaatttttaaaagtcacatttcaggtcatttccccaataacagttatacttttatactttttttttttttttttttgagacggagtcgtgctctgtcgcccaggctggagtgcagtggcgcgatctcagctcactgcaagctccaccttccgggttcacgccattctcctgcctcagcctcccgagtagctgggactacaggcacccaccaccatgcccagctaattttttgtatttttagtagagacggggtttcgccgtgttaaccaggatggtctcgatctcctgactttgtgatccgcccgccttggccccccaaagtgctgggattacaggcgtgagccaccgtgcccagctttaatttttttgttgtttttttagtagagacggggtttcaccactttagccaggatggtctcaatctcctgacctcgtgatccccccacctcggcctcccaaagtgctgggattacaggcttgagccactgtgcctggcctttttctttttctttttcttttttttttttttttgagatggagtcttgctctgccacccaggctggagtgcggtggcacaatcttggctcactgcaacctccacctcccgggttcaagcaattctcctgcctcagcctccttagtagctgggactacaggcgcatgccacaatgcctggctaattttttgtatttttagtagagacgggtttcaccatgttagccaggatggactcgatctcctgacctcgtgatccacccgcctcggcctcctaaagtgctgggattacaggcatgagccaccacgcacagccatacatttttaatttatacgaattttggctgaaatgtcttcctctcacatgttatctcattcttctcattagtacagaattcaagaatgttgaattggtgtggttaacacaatacatatgacttgaaattggcatacttgcaactcagagatgggtttaaaaagacagttaacatccctgttaaattcatatattgtgatcttaaaaatgtgattctaagttgcctttatattttctttcagttgctgtaaataaatgtaacaaatcaaatacagaaatggaacatgcatgacacttagattttcaacttaataggaaaccatcagatagtgtgggaaattcagtgtcttggttatcaaccagttgtagctcatctacaggtgttttttgttagattttgtttttctctgagatatgagagtttaaaggactgtgcaggaaatttttccttgtgcctatttttttccccatctcttaactgaagtcaatgtaatttatctccttaggaactcaccttcgaggcttggaaaccacagccacgtatgaccctgaaacccaggagttcattctcaacagtcctactgtgacctccattaaatggtggcctggtgggcgtaagtgaatttttcagcatttattggatgttttgaaggtttgtcatgagattttgcttagaatgtagagcttttatgataatgtcggccagacttggtggtgaaatcctaacactttgggaggctgaggtgggcagatcacttgaggtcaggaattcaagaccagcctggttaatatgctgaaaccccatctctactaaaaatacaaaaattagccgggtgtggtggcgcacacctgtagtcccagctacttgggaggctgaggcaggagaatcacttgaacccgggaaggttgcaatgagccaagattgcaccattgcactccagcctgggcatcacagcaagactttgtctcaaaaacaacccaacaaacaaatatatgtgtgtgtggtgtgtgtacatagaggggtgtgtgtgtgtgtatatagacagagagaggtgtgtgtgtgtatatatatatatatatatatatatatatatatatatagagagagagagagagagagagagagagagagagagagagagagagagagagagagagagaggaaagccaggcatagcggcacatacctatagacctatagtcctggctactcaggaggctgaggtgggaggaccacttgagcccaagagttcaagcctgcagtgagctactatctgtgatcatgccactgcactccagcctgggtgacagagtgaaaccctgtctcttaaaaaaaaaaaagaaaaaaatttaaatagttttaacacaaacttttttttttttttgagatggagtctcactgtgtcacccaggttggagtacagtggtgtgatctccgctcactgcaacctccaccttctgggttcaagcgattctcctgcctcagcctcctgagtagctgggactacaggagcgtgccaccacacccaactaatttttgtatttttagtagagatgggatttcatcatgttggccaggctggtctcaaactcctgacctctggtctgcccgcctcggcctcccaaagtgctggaattacaggcgcgagccaccgtgcccggctgacccgaaacttttatatcttcttattccattctgagttattatcttggaatatatatttccaatacagttagtggttgaaggattttgttattcacattatatattttatttatttataatttatatgtaagaagccacatgtagctagtgattactgttttggacagcactgccttaagggataacaaggaagtagtttaaattaatattcttatttttatcctaaaattttctctacgtaaatgtatgagaaataagtagaaaagaaagtaataactattagcttaagggaatttctttctgaaagctaggtgtgatgctgtcagcagaaaggctttctggacacatactattggtttagtctagtgttagatttaacatattctttcttcttttttctaccctttaaaaatgtatgaacgtttgcccacccctcccttgttctctttgatattacagttggaaagacttcaaatcatgcaatagttcttgcccagctcatcactaaggggaaatgctatggattacatgcctttatcgtacctattcgtgaaatcgggacccataagcctttgccaggtaagaactgttcatctgatgttgagatgaaaatgaaactgagcactttcttctgcaaaaggtagaatgcccaactgaagaggcggagcaaaagccagaaattccagagcataaacatctcgtgactgtcctttcatctgtggtaggaattaccgttggtgacatcggccccaaatttggttatgatgagatagacaatggctacctcaaaatggacaaccatcgtattcccagagaaaacatgctgatgaagtatgcccaggtatgttttgatagaaaataaagcagaggcatcaaacagtggagttgagtggctgttactcacaatagggttagaatggtctgttcttttagaaggtaataacagcagggcacactggcatattcctgttatcccagcactttgggaggctgagtgcgtggatgacttgagcccaggagctcaagatcagtctgggcaacatagtgagaacccatctctacaaaaagtaaaaaaatctagctgggtatggtggcacacgtgtgtagtcccagctacttgggagactggggtgggaggatcacttgagcctgggaggccgaggctacagtgagctgtgattatgccaccgtactccagcctagatgacagtgagaccttgtctcaaaaaaaaaaaggaggctgggcgcagtggctcacacctgtaattccagcacttttgggaggctgaggcgggaagatcatgaggtcaagagatggagaccatcctggccaacatggtgaaaccccatctctactaaaaataccaaaaaattagctgggcgtggtggtgcgcacctgtagtcccagctactcaggaggctgaggcaggagaatagcttgaacccgggaggcggaggttgcagtgagcagagatcatgacactgcactccagcttggcaacagagtgagactccgtctcataaaaggagggaataaggctgggcgcggtggctcatgcctgtagtcccagcactttgggaggccaaggaggatggatcataaggtcaggaattcaagaccagcctgaccaatatggtgaaaacctgtctctactaaaaatacaaagattagccgggtgtgatggcacacgcctgtaatctcagctactcaggaggctgaggcaggagaatcgcttgaacccaggaggcagaggttgcagtaagtcgagatcacaccactgcactccagcctaggcaatacagcgagactctgtctcaaaaaaaaaaaaaaaaaaaaaggagctaataatgcatttttccttctgatgccccttttttttttttttgagagagagagtctctgtcacccatgctggagtgcagtggcgtgatcttggctcactgcaacctccgcctcctgggttcaagcgattctcctgcctcagcctcccaagtagctgggattacaggcatgcgccaccacacccagctaattgttttgtatttttagtagaggtggggtttcaccctgttggccaggctggtctcaaactcctgacctcaggggaccctcttgcctcggcctcccaaagtgctaggattacaggcatgagccaccgcacccagcattttttggtttttttttttttttgagacagagtcttgctctgtcacccaggctggagtgcagtggcgcaatctcagctcactgaaacctccgcctcccaggttcaagcgattctcctgtctcagctcctgagtagctgggattacaggcacgtgccaccacacgcagctaatttttgtatttttagtagagatggggtttcaccatgttggtcaggctggtctcgaattcctgacctcttgatctgtctgccttggcctcccaaagtgctgggattacaggcgtgagccatcacgcccactctgatgcttcttttactgcgacagtgaaatcagaaacagttgtcagggttgaaggacatattttgatttgctaaaccaatgattctcaaacttttgcatgcgttagaatcacctggaaggccagttaaagcccaggttgctaggccctaccctggagtttctgattcagttggtcagggtggggactaagatgtagtatttcatgcaagttgccaggtgatgctgatgctgctattccagggaccacactttgagaaccactgaactgcctcttgggcttaaaagaaggaagtatcagttccacgttcttcttccaggtgaagcctgatggcacatacgtgaaaccgctgagtaacaagctgacttacgggaccatggtgtttgtcaggtccttccttgtgggagaagctgctcgggctctgtctaaggcgtgcaccattgccatccgatacagcgctgtgaggcaccagtctgaaatcaagccagggtaaggatagggtcctagatgggctcagtaccaaaggcctagtttttaccccattcagatcccagaattcccaaatgtcaatacagaagatgcattagcactgcaaaattggctagggtgataactgggcctgtaatttcatatctaggcttccttttcttaagaggaaagacagaaataaccacccttgctataatcagtgactgccaaaaaagaaaaaaagagaatacccaccttattatttttaactttttaagaaaaatagtaataatattacttgaactttataagtgaaatgttcaacacactaaaggcagtttgaaagttctgattactactagcaactgtaaattgtgcatggtgaaagtgacattaaatttgtttcccttttgcattcatagccacagtttattcctacaactgcctttcactgatactccctgatactctttttactcctaaggaataaagaaactggccaggtgtggtagctgacacctgtaatcccagcactttgggaggctaaggcaagaagattacttgagcctaggagtttgaggccaacttgagcaacatagtgagaccctgtctctattttcttttcttttttttttttttttgagatggattctcactctgttgcccagactggagtgcagtggcgcgatctcagcttgctgcagtctctgccaccctgggttcaagtgattctcctgtctcagcctcctgagtagctgggattacaggtgcacgccaccatgcccagctaatttttgtatttttagtagagacggaatttcgccatgttggccaggctggtctattttcaaaaaaattaaaagttaattaaattttaaggccaggcgcagtggctcacgcctgtaatctcagcactttgggaggccaaagcgggtggatcacttgaagtcaggagttcaagaccagcctggccaacatggagaaaccccacgtctactaaaatacaaaaattagctgggtgtggtggcgggtgcctgtaattccagctactcgggagactgaggcaggagaatcacttgaacccaggaagtggaggttgtagtgagccgaaatcacaacactgcactccatcctgggtgttagagacttcatctcaaaaaataataataataattacatttttaaaaaggaataaaggaattgatacaatgagacccttgctaattcttacacttcaaaatatttaacaccatccattgggtcttctccaagattgtggtcaaaatacaatgtattcagccatctggtgagtagagctttttggcattgccttcttattaggttgactagcgttggttttgtatgttgctatgagctacggttttcttagtcatactggaaagactaggacagatatggactttgcagccagaaaattctgtcagcctacgcagtacaaggtaattacagcatggtcttagggagccaaatagcctaggcaccgtggctcatgcctgtaatcccaccactgtgggaggctgaggcaagagaatcgcttgaacttgggaggcggagcttgcagtgagccaagatcgcaccactgcactaaagcctgggtgacagagggagactccatcacaaaaaaaaaaaaaaaaaaaaaaaagcctcaatttaaatctaagacctgccacatacgagctgtgtgacctcaggcagattcttaacctctcagtttcccatttgtaaaatggagatagtaatagtaactacctcacagtgcccttaagaggactaaataagttaaaataccaagtgcttagattagaacctggcatatagaaagttctgtataaacatttacttactactttttttctttttctatgtcacgtagtgaaccagaaccacagattttggattttcaaacccagcagtataaactctttccactcctggccactgcctatgccttccagtttgtgggcgcatacatgaaggagacctatcaccggattaacgaaggcattggtcaaggggacctgagtgaactgcctgaggtatgagtttggtctcattcactcatgggcacccttctgtttcgtggttgcctgttggatgaggtccagagataactaaatgttggtatttcctgaaaagaagtatgtattctgagaacttcttctggttgaaagtagatcagatatgaagatctgtggggtttgttgttcagtatttttagtgttatcagaaatactgtaccatgttgattatttgtcaatcaaggaaatgtaagtggtgaatgtttagccaagtagaacagcttagatgggcatgggtagtgttctgtattcttctggccagtcggacagctgtgcttcttcagtttgcatgtgtggcagctgtgttttgacagtggccaagatgttagaggaggggtgtgttttctcattggttctcgggctctcagcaccacagatgtcctgacagatctgtgcttgtcctctcagcttcatgccctcaccgctggactgaaggctttcacctcctggactgcaaacactggcattgaagcatgtcggatggcttgtggtgggcatggctattctcattgcagtggtcttccaaatatttatgtcaatttcaccccaagctgtacctttgagggagaaaacactgtcatgatgctccagacggctaggtgagagtcaaatcctcgattcctcccatctgttcataagaatgttctagtccttttcctaggttcttgttcccatggtttttcttcaccgtatatatatatttgttcctgaaaggtatacttttgccttccatcctgactcacggtttttatttcgtggtgaggctagagagtatgaagcacctgttacatagcttgcagttgtatcaaggatagagttactgggctgggcacagtggctcatgactgtaatcccagcactttgggaagctgaggtgggcagatcatgaggtaaggagttcaagaccagcttgatcaacatggtgaaaccgtgtctctactaaaaaaatacaaaaaaattagccgggcatgatggcacattgcctgtaatcccggcctacttgggaggctgaggcagaagaatcgcttgaacctgggaagcggaggttgcagtgagccaagattgcgctattgcactccatcctgggcaacaagagcgaaaactccatcaaaaaaaaaaaggccaggtgtggtggcttactcctgtaatcccagcactttgggacgccaagccgggtagatcacttgaggtcaggagttaagagaccagcctggccaacatggtaaaaccctgtctctactaaaaaaacaaaatattaaaaattagccaggaatggtggcaggtgcctgtagtcccagctacttgggaggctgaggcaggagaatcattcatttgaacccaagaggaggaggttgcagtgagctgagatctggccattgcactccatccagcctaggcaacaagaatgaaactccatctcaaaagaaacaaaagaaagtagagttactaaaagcatgtttactggtgacttttaggttcctgatgaaaagttatgatcaggtgcactcaggaaagttggtgtgtggcatggtgtcctatttgaacgacctgcccagtcagcgcatccagccacagcaggtagcagtctggccaaccatggtggatatcaacagccccgaaagcctaaccgaagcatataaactccgtgcagccaggtgagctctccctcaagagctagaatacgcagcagtggggctggggccctgacagatggcaagaaggcatgagtactgttgatcatttcctcagacctccaatctatgtcttaacagattagtagaaattgctgcaaaaaaccttcaaaaagaagtgattcacagaaaaagcaaggaggtagcttggaacctaacttctgttgaccttgttcgagcaagtgaggtcagtggtagttctctctttttccccttccctgccctcagcatcccgcattttctggtacagaaaccctagtcactgtatattgaatctttttccaaggttctcaaactctggtgttttctttttaatcttaggcacattgccactatgtggtagttaagctcttttcagaaaaactcctcaaaattcaagataaagccattcaagctgtcttaaggagtttatgtctgctgtattctctgtatggaatcagtcagaacgcgggggatttccttcaggtcagtattttctaagtataagtcttttttgttgttgttttaagaaaaataattgttggctgggcacggtggctcatgcctgtaatcccagcactttgggagcccaaggcgggtacggtgatcacttgaggtcaggagttcaagaccagcctggcctggtgaaaccctgtctctactaaaaatacaaaaattagccaggtgcagtggcacatgcctgtaatcccagctactagggaggctgaggcacgagaatcatttgaaccctggaggcagaggttgcagtgagccaagatgaaaccactgcattccagcctgggtgacagagcaatactctgtctcaaaaaaaaaaaaaaagaaaaagaaaaatagccaggcacagtggctcatgcctgtaatcccaacactttggccaaggcgggcagatcacctgaggtcgggagttcgagaccagcctgaccaacatggagaaaccccatctctactaaaaatacaaaattagccaggtgtgctggcgcatgcctgtaattccagctatttgggaggccaagggaggagaattgcttgaacctgggaggcggagattgcggtgagccaagatcacaccattgtactccagcctgggcaacaagagtgaaactcagtctcaaaaaaaaaaaaagaaaaaaataattgtcatccgctttatagctgtatatgcatataattatgtctatctatatacatatatatgttttatttacttattttggtctcttttaggggagcatcatgacagagcctcagattacacaagtaaaccagcgtgtaaaggagttactcactctgattcgctcagatgctgttgctttggttgatgcatttgattttcaggatgtgacacttggctctgtgcttggccgctatgatgggaatgtgtatgaaaacttgtttgagtgggctaagaactccccactgaacaaagcagaggtaaaaatccagtgtctctgcacctttttaaaagtcttcacttaaatattgaagcaggaaaggcctctcgaaggggatttatctgtgaaagctctgaaagtaccatggccacttctgacagtcactttatttgagcaacaggttcagaagggaactgggttgttcccacagtaaccagggtcttaatcaatttcaatttttgataacgaattgaacatttaaaaatatatacaggccgggtgcgttggctcacacctgtaatcccagcactgtgggaggccgagtgggcagatcacctgaggtcaggagttcgagactagcctggctaaaatggcgaaacccaatctctactaaaaatacaaaaaaagcagccaggcagtaatggtgcacggctgtagtcccagctactcgggaattctcctgcctcagcttgaacccaggagaacccaggaggcggaggttgcagtgagccacgttcgtgccattgcactccagcctgggtgacaagagcaaaactctgtctcaaaaaaaaaaaaaaagtatacacacacacacacacacacaaatagaataaaatatacaaaaagagaattccgtagtgctctttggtacaccctttgtctagcagcaatgactatcaactcgtggctagttgtgtttcatctgaaccttcatccccctcctcctggggactattttgaaataaatctaagacatcagggccaggctcagtgatgcacacctgggaggccgaggcaggtggatcacctgaggtcgggagtttgagaccagcctgaccaacatggagaaaccttgtttctactaaaaatacaaaattagccaggcgtggtggcgcatgcctgtaatcccagctacttgggaggctgagacaggagaattgcttgagcctgggaggcggaggttgcggtgagccgagaccatgccattgcactccagcctgggcaacaagagcgaggctccgtttcaaaaaaaaaaaaaaaactaagacatcagataattttatccataaataattcaatgcatagctctaaaagataaggactcttcagaaacaaccacaggctgggcacagtggctcacgcctgtaatcctagcactttgggaggctgaggtgggtggatcacttgaattgaggagttctagaccagcctggccaacatggtaaacccccatctctacaaaaaaatacaaatagcagccaggtgtcatggcacacacctgtagttctagcaactcgggaggctaaggtgggaagatcgctggagtctgggaggcagaggctgtagtgagccaagattgtgccactgcactccagcctgagcaacagagcaggactcagtctcaaaaaaaaaacaaaaacaaaaacaaaaaacagtatactatttaacatggcaaactctttattagtagttcttctctctcctttccccacaggtccacgaatcttacaagcacctgaagtcactgcagtccaagctctgaagtgtcacaaggacaagtttaatctgcttcagaaagcgcctgtgtgcaactcaaattttgtggaatctttttcgaattcaaatagctatagagcaaatgataaattgacccctttttataaatggagggaaaaaatgaacagatttcagagattaaatgaaaaaaagcagatgttttaagtgcaattaacactgaaagagacctgttaaaccattcagaaaaagcttaagaaatgcgatatgacttccttttgtaatgctgctgatcccagtagactatgacttttgataattagcagaatttaactactgagtagttgattattttcacattttaattgctaatcactggctatataagtgtttttaagcaaaggtatttttgaagtggtgtagaacccttccaagctttcctgctcagtgttctaccagacttaccctggggcctggcttaaaagcaggattgaagaaaagggactgggggaaggaaacttattggaaaacttgatgcgaatgagtttctgcttggcacagtctctgcctgcttgctctcctttgctgatggattgcatttatcaaactattcatgctagcatttttccaacgagggaacttattccgcacgggcctactgtaggaccattgtctcgtgtaattaggaattttccatttgaaggattgctaaattgtcacagtagtaggaagtatagggaaacctctcagctgtggcactgttgtagctttggagtgcagagtgtaactctgggacaatcagatttcacatattctgtcatcttggcataagccattaaaagcttggagattactgtatttggcattaaaaaaaaatgtcacttaggtcagcactcccagacgtagcacagaaaaaccctttgacacaaaccatgtgttctgatttttggttcagaaaatattgaaactgtgagttgttttttttttaacaactgggaaaaaacaaaaacaaaaaactatagttagaaaaatggaagttccataggttctatttcttactctatgtatggctttgttttcagtctatttctaggagctttctctgaatcgctaattgtcctttcagttgaaatctaatttatacaatcattctatacttaaaggttaaatacatcttaattaattttttcttaaagtcaatgtaagtcactttgttttgtttttttttaatctacgccatatgcctcatgaaaccagctgttctagaatcagtcctgagaatatggcttaattccatggaaacataactcctatcttgggacctgacataatatctatctatcctggggaactggtaatatgagacttataggttacagcagaaatgctacatgttgacaaaagccttaatcgttccactgggagaactaattgataattgtgttaagattgaagattaaccctgtgttaatctcacttgagtctatcctgacagtagttcagattctggaaaatgataaactgacctgctagatgtagaattgtttcaaaattagtgttgaaataccttgttcacagatgaatatctgggcaggatctgagggtgtttggaatgacaccccccaatccagttgcatagatgggatgtctttgcaggtttgaggagatcatcgacctgcagagccccctttgacccagtacctcacgttttatttaaaatctaaatctggggccaggcgtggtggctcacgcctgtaatccaagcactttgggaggccgaagcgggtggatcacctgaggtcaggagtttgagaccatcctggccaacatggtgaaaccccgtctctactgaaaaaaatacaaaaattagctgggcatggtggtagcacgcgcctgtagtcccagctactcgggaggctgaggcaggataatcgcttgaacttggcgggtagaggttgcagtgagccaagatggtgccactacactgcagcctgggtggctgagcgagactccgtctcaaaaaaaaaatctaaatctgacatttgatgctatttttattaatattggaatgttctgtcttgaactttattcaatataatcaagaataaagatagagtaaacgtcactgatttgtactattaagagagaaaaaatatgccacacaactaaacataggtttaaattatgaagaaatttagaatagaggtttattagatttagggaacactaagaacaaaaaaggaaggagtgatacctgcctgagtggacagctgtaaatcagctgtaattactgcagttgtaccaatagttgtgagtggctccagtcactttaggagtccttggaagtacttggtacacatttgttggctgtaccttaaaggaagtggcaagtccagtttgttctctctaccacactagactgccactgacaagtttgggtctgttggattcaaaattttgtaagccattttcacaagtacaaagatacattttaaccttgtcttctccaaaattactgagtaggaattttatttttatctttttgagacagggtatcactgtcacccagactggagtgcagtggtgggatcttggcttactgtgacctctgcctcccgggttcaaatggtcctccctcctcagtctcctgagtagctgggacgacaggcacgtgccaccatgcccagctaatttgttctattttttctgtagagacggggttttgccatgttgcccaggctggtctcagactcctgggctcaagcgatcatttcgcctcagcctcccaaagtgctgagattataggtgtgagccacagcatctggcccagagtgaggagaattaatgagattttttgtgtgtgttagataatattgatttaagcctttttttaaaaagtactctcaaccaaatacaaaattgaaaatgtgaggtttaatagaaatgtgttggctatttgcaatggattttcttcttgcccaagtgtttggagttctactttatgctctgtatttaaaaattagtgacctcaaagcagagttgatgacacaggctttggggccctcatgttcttgtctttagaacatatcactactaagtatcagcttatcttcagaacattacaacattcaccgtgttcatatgctttctgagaagtcaccacttgtaatttcagatcacatacacctgaaggcattttatagttcctaaagttaacatgttagatcttttttttccaccccatgagggtctcactctcacccaggctggaatgcagtggtgtgattgtagcacactttggccaccaactcctgggctcaagtgatcctcctgctttggcctcctctgagaagctgggattactggtgcacaccaccacacctggctaattttttatttttttttatttttggaaatagggtatggctatgttgccttgggcccgtcatgaactcctagcctcaggtgaccctcccacctcaggcctcccaaagggttgggattacaggagtgagctactgcactgggccaacatgttaatttttttttttttttttttgagatggagtctcccaggcgggaatgcaatggtgcgatctcgacttcactgcaatcttcacctcccgggttcgagcgattctcccacctcagcctcctgagtagctgggattacaggcacctgccatcacgctcggctaatttttgtattttgagcagagatggagtttcaccatgttggccaggtgatctgcactcccactccccccacacttcccaaagtgctgggattacaggcataagccacaagccacctcacccagccaacatgttacatcttaattcttggattttcttcactgcagggctttgggtggagaaataaaactcttcaaatgcatgatcttggagatccctgtgaatcaataattctttagacaactgcggctcaaaatccctcctttcccttttccgagttattccatccatcttattagaaaggaagtgaattaggtgtaggtggtctgtaacacctgcacatctttttatacgtgtagagggtatgcctgggatatataggttgtcttcaagcagtagctgctactacagctagagagaggaggagtgccaggaaactgatgacctgagaccaagagtcttgttgatgttctgacttagataaaggttttgatcattttcatgaaataatgcagggaagtcatttctgctgtttctttactactccattcttggaggattagaacaagtcacactgtaattgactaaaacgactttttattttaaaatattgatggtggggttttgcttttttttttttttttttttttgagacgttgtcttgctctttcacccagggtagagtgcagtggcgaaatcttggctcactgcaacctctgcctcccgggttcaagcaattctctgcctcagcctcctgagaagctgggattacagcgcctgccaccatgcctgtctagtttttttgtatttttagtagagacaggggtttcaccaagttggccaggctggtcttgaactcctgacctcgtgatccacccacctcggcctcccaaagtgctgggattacaggcgtgagccaccgtgccgggccagtgtttttaactgtccacacttactaaattttccagtacttcttcctatggttcatgatagtaaacacagaaacatataaggaacattattagagttaccagatgttagctgttgcatatgtgcacattcctagattcaagggtgtttttgccttaaatttaagtgggtcattggttgtcttgggaagatcatggaaaattcgggattttttagaattctgaaccaaaatatgttttgagtgtttcttagtaaatgtgtgatcttccaccttccacattcagactgcggactacacttcataaatgcctttttatttccagttatggattcaactaaatgactgccttgggagcacataattactttgctacctttttccccctttgctgttgtggctcgagtttggttctcacctgagaagatgcattgagcatatgttgttacccagccctggcttaatggtgtcctgtggggtaggggtgggaggacgaggggcacggggccagagcatgtgaatggatcatggttggacagctgtgacctgccagcactgcgggtaagcaaaactacaaaccgttctttcctctgtgacattgaataaaccttaataaaattcataattagcacatactagaaaaaatgtgacttaatctttttgtggggcgacagtattgggtttcattctggctatacagctttgattggatcattaaacaggtcagtcacttccctcaagctttggggtgtggaataaacaccggtgaatttgtggattcacccgtcaacctcccaatatcaacacatttctcacgcctccgcgtcggccacgtgtcagccctcagaagtgggcaggaggaacttttaagcttcccggcagttcccaagagggcctttgagcctggcgccctcttcccggagaggcgttggggcagctcctagcaacgtgcccgccgccggcagaagcccggccccgccaactgccgcgcgcggctccctgggagctgtagttcttcatggcgtccccacctcctctgtgagggcgggtgagtcgaccgccgactgcgactcccaggatgcctcgcgcccgcctttccgcgggaggccagacggctgagggtgccggcagcggctggaagcgggaggccagtcctggccgggctgggcgacccgaatggagccagggccggcgctggtcccagcggccgcacctccgggggcacggcgcgtaacaggaggcttccggggctgagagcgttacaggctgcgctccggggccagataggccgggcgctcagaagggtgacgcattgaggggcgcggagtctcgggacggaggggcgactccggctaggggtcttgcttaggggtggtctcgggatctgtaaaacgcctggcatggagtcggctgaatacatgtggggacggggttactctgtagccctttggccttggcaaaccaagcctagaaaatccccatagtctgagaagcccgtacaggatcgataggagatgccagaagttccttgatgtgttatgggacacatttggacttgtaggtcgtgaagtcgccattgcagagaaaaagaaacaaggccgggcacggtggctcacgcctgtaatcccgacactttgggaggccaaggcgggaggatcacttgaggccaggcgtctgggacgaccctgggcaacatagggagacccccgtctctacaaaaaaaattttaaaatttgccgcacatggtggcgtgtgcctgtggtcccagctgctagggaggctgacattggaggatcgcctgagcccaaggaggtcgaggctgcagtaagctatgagagctgtgatcgtgccactgcactccagcctgggcaacagagcgagaccctgtctggaaaaaaaaaaaagaaagaaggccaggcgtggtggctcacacctgtaatcctagcactttgggaggccgagacgggcagatcacgaggtcaggagttcgagacctcctggccaacagtgaaaccccgtctctactaaaaatacaaaaattaaccgggcatggtggcatgtgcctgtattcccagctactcgggaggctgaggcaggagattcgcttgaacccgggaggctgaggttgtggtgagccaagatcgcaccactgcactccatcctgggcaacagagcaagactccgtctaaaaaaagaaaaaaaagaaaacacatgtattcagggtgggctctgtaggtaagcccagataacccttgcattccaataacaggacaggccaatacttgggacataaagaggacccctctgactcctttcttccaggacatcctgtaggtgggttttggtaaagtggaggagggggagggagacagctaattccgaggaaaatgttctcaatgggtcagatttactgcctatgtaaagggaaatatttccactgtcagtgaaaatcgtgttgctggacgtggtggctcacacctgtaatcccagcactttggaagaccaacgcaggaggattgcttgagccccagagttcaataccaacctgagtaacacagtgagaccccgtctcgaaaaaaaaaattttaaaaagaaaaagaatatcaaagagtaaccagagttcatacctgcttttgtgctaaatg

SEQ ID NO: 26 - DNA, 56055 bp, Homo sapiens
ttatgggaagtgctgtatttcagcgcacactctgaatagcataatcattactaaaagaattttttttttgagacggggtctcactctgtctcccaggctggagtgcggtggtgtgaacacggctcactacagcctcaaccttccaggctcaggtgatcctcccacatcagcctcctaaacagctgggactacaggtgcaggccactgcaccaggctaattttctgtgggttttgttgttgttattgtttgtagagatgggttttgctatgtttcccaggctggtcttgaactcctgggctcaagtgatctgcccgccttggcaggactacaggtgtgagccattgcaccctgcctaccctggcccattgactattatgaattaaaggctattgaaaaacagcaggtgcatcgctggcaaaagtatacttgtgtaacgaacttgcacattctgcgcatgtatttcagaacttaaagtaaaaataaaataataaagtaggccgggcgtggtggctcacgcctgtaatcccagcactttgggaggccgaggcaggtggatcacaaggtcaggagatagagaccagcctggctaacatggtgaaaccctgtctctactaaaaatacaaaatttagccgggtgtggtggcgggcacctgtagtcccagctacttgggaggctgaggcaggagaatggcgtgaacccaggaggcggagcttgcagtgagctaagatcatgccactgcactccagactgggcgacacagcaagactctgtctccaaaaaattaaaaaaaaaataataaagtattcagggataaagagagaaaaataaatttagattgtatacatatgtaaaatatattttaaaaggtaagcttgtcttttttattccttaaaggagcagatattaaaaaaaaaagaatagaataactcatctttttagcctccacatatttacttgcttcttcccaagttacttggtctaattcagtatataagtaactgactctcactgctttttctgtgccatgtaaaacttgcattgtattaatttgtgtgcttttctcctgtggacctgtcttatgtcaacttaattctcaggcccagccaaaaaaaaaatacccttaaagggagcttagcttgcctccatgaccctcaatggtggctgtaatcaaaccacatcttccaggcaaacaataccacatcctatggccttgcaatggcatggcctccctccagcacagcctctctggaggagggggaggcaagggtggtgagatctcaggcctccctcatgctacctcctattagttatatgacccctggtgtcacctctcccaccacactgtaggctccagggagtaggattcacatggggttcatttgtcctccctgccttcagcagactccaggcacaggtgttcccagagtaaagggctcactgtctgcttcctgggtgaatcattctccccgcaaacccatgaggtgagtgcagtcgtggcttcagctcaccgcctgacaggctccaggctgtagcacagggagggccctgtggactctgctgaggaaccatacgagctcccagaggccaagtgcaggacagagaatagagaagcagctgctcagagaactctagccctgtagaggtgcaaatatggctgctattatacagaaggtgaggccaaaaatgctggagacactgctcctgaatctcagttttgccacttgtaaaacagggaaaacaacctactctcatgtccccaggttgttaggaaaatccactacatgaagatgtgcagtctctggctgggagcaggacaccagctgcccaacagcacaggctcagggcatggcactgtctccactgtccccatccccaacctggaagctagagcctcgctgccctgccacttctggatgcaggacagagaaccggaactgggactgtggtctctcagtagaggctgtgaacagccatctgtggccacacggattgagacctttcctgctcactcttcaaactggggcaccggctgggtgcccaacagaaagacaattggaagagtggcaggtaaaccaggctgtggccctgcagtgccatcaccgtcctcatttgaattctggctcgtctgttcctctacggcccctccgcatggcgctccaccccagtcttcagaaatttctgcctcaagctcagggagctggtactgaggtacaggtaggagaaggtgcagcctctgctgagtggaggacatgtgccctggggatccagagtctagagtgactgacaccagccctgcaatttgtcctcctagacctgttaacagagcctgcagaagtttacacagggctgctgaagatttttatcccctcattttacaggaaggagctggggccataccagagtcagagctggaccgggagcacggcagggcccagccatccacagcctccaatttcagtactctctaacaacctgagagcctgagccttcggatcttcttgattcctactttgataaagagagggatggggttggaaggacctggcatagagattggaccagtccggcattgacagagccaggacctggggtccggaactgagctcagctccaggctcatctgaagtcaccctgacagcctgaggatggagaccttatttccattaacaggcatggcggttggcagggactggccccagctgagcacggttttccaagtacacagctgggaattaagtcttctctgccgccctcccctgtagtcttgcctggatccccccagtcatctactcccagtaccaaaaactcctgtattcttgaaaatccgtagtactgagaggtgacagcttgctggcagtcctcaacagccctcgctcgctctcggcgcctcctctgcctgggctcccactttggcggcacttgaggagcccttcagcccaccgctgcactgtgggagcccttttctgggctggccaaggctggagcccgctccctcagcttgcacggaggtgtggagggagaggcgcgagcgggaaccggggctgcgcgcgcggcacttgcgggccagctggagttccgggtgggcgtgggctcggcgggccctgcactcggagcagccggccggccctgccggccccgggcaatgaggggtttagcacccgggccagcggctgcggagggtgtactgggtcccccagcagtgccggcccactggcgctgcgcttgatttctcgccgggccttagctgccttcccgacgggcagggctcgggaccgccatgcctgagcctctcaccccctccgtgggctcctgtgcagccggagcctccccgacgagcacctccccctgctccagggcgcccagtcccatcgaccacccaagggctgaggagtgcgggcgcacggcgcgggagcacggcgcgggactggcaggcagctccacctgcaaccccggtgcgggatccactgggtgacgacacctgggctcctgagtctggtggggacgtggagaacctttatgtttagctaagggattgtaaatacaccaattggcactgtgtatctagctcaagttttgtaaacacaccaatcagcaccgtgtgtctagctcagggtttgtgaatgcaccaattgacactctgtatctagctagtctggtggggccttggagaacctttgtgtccacactctgtatctagctaatctggtggggaagtggagaacatttgtgtctagctcagggattgtaaaccaccaatcagcgccctgtcaaaacagaccactccgctctaccaatcagcagggtgtgggtggggccagataagagaataaaagcaggctgccagagccagcagtggtaacactgtggaagcttccttctttccctctgcaataaatcttgctactgctcactctttgggtccacactgcctttatgagctgtaacactcaccttgaaggtctgcagcttcactcttgaagccagcgagaccacgagcccaccaggaggaaagaacaactccagacccactgccttaagagctgtaacactcactgggaaggtctgcagcttcactcctgagccagtgagaccacgaacccaccagaaggaagaaactccgaacacatccgaacatcagaaggaacaaactccagacacgccgcctttaagaactgtaacactcaccgcgagggtccgaggcttcattcttgaaggcagtgagaccaagaacccaccaattccggacacagtaccatgaaggaatgaaaatacataacaatgtgatgtatcatgttttatttcctagactagtgacaaatgaaagctaagtgtagcaagggtgcagggacacaggcacatttgtggactaggtgtgagtgtaagctgggttcgatggtcttttggccaacatagtgaacccctgtgtctactaaaaatacaaaaattagccaggcgtggtggtgcaggcctgtagtcccagctacatgggaggctgaggtgggagtatcgcttgaacctgggagacggaagttgcagtgagccgggatcacaccaccgctcaccaatctgagccacagagagactgtctcaaaaaataaaccacaaggaagggaggtagggggagggggagggagggaggaaagagaaagagagaaaggaaggaaagagaaagcaggaaggacggaaagaagacgaaagaacgaaagaaaacgaaagaaaaaaggaaagaagagagaaggagagaacagaaggggcaggtgcccctgggaaggggagaagatcaagacgcgcctggaaagcggactctgaacctcaagaccctgttcacagccaagcgcgcgaccccgggaggcgtcaactccccaagtgcctccctcaactcatttcccccaagtttcggtgcctgtcctggcgcggacaggacccagaaacaaaccacagcccggggcgcagccgccagggcgaaggttagttccggtcccttcccctcccctccccacttggacgcgcttgcggaggattgcgttgacgagactcttatttattgtcaccaacctgtggtggaatttgcagttgcacattggatctgattcgccccgccccgaatgacgcctgcccggaggcagtgaaagtacagccgcgccgccccaagtcagcctggacacataaatcagcacgcggccggagaaccccgcaatctctgcgcccacaaaatacaccgacgatgcccgatctactttaagggctgaaacccacgggcctgagagactataagagcgttccctaccgccatggaacaacggggacagaacgccccggccgcttcgggggcccggaaaaggcacggcccaggacccagggaggcgcggggagccaggcctgggccccgggtccccaagacccttgtgctcgttgtcgccgcggtcctgctgttggtgagtccccgccgcggtccctggctggggaagagcgtgcctggcgcctggagagggcagggagagagggggacacggcgggggtgcgtggcccgggtcgcctgcggccgggcatgtccgggcaagacgcaccagtcgtcggagtcgggggaagagatgggtccccgggttgggcaggagcgacctgggccgccagggaacagagcgcgcgctccacttggtgtaaattcccgaatccagtgggggagggcgacaaggagggaattcccgagtaagctgcgtgaagccacggagaggtcgtcggactttgattttgttttctttccttactttctgtttctttctctttttctctttcttcctttctttccctcccttccttcctcgctcagttcctgccttaatttctttttcttttgcgccttcgaatgaattcctaaaggcgctcattgcagatcgctttgaacctgcggccggcgaagaactcccctgtggtcgctgcggcccagtggttccgttccgtgcgcgggagtcgtcgcgggcgcagctggagaggccccttcccctccttagcggctgcgcccctacgcgtgcggggccgctcatcgccaatgccattgtttggggttccttgggaaaacgagatttaggagaagggagttgtggcacttggggcctgacctgcttgataatagcagctgcattttggcctgggaagagcctttcttgccacctcttggcaagtatccgtgataatggggaagggacaaagagtcggctttgtagggaacagcatggtgtgctcagcgcctggaactgcgcttggggccaggagaggttctgaatcatcacattttacagaggaagagaccgcagctcagagtggggaagtgtgtgggcctagacctaactcaagactgtacagaggggctggaagggagaggaggaacagtgaaaggaaggtcaagagaatgctggtgttgacctagaagaatgtcagtgtgaagcattggagtttcatgggatattgttacacacctcatgttttcactgtttccgccccacaccacagtatgtccttggtctcacctctgagtggagggaggacctaactgtcctagtgaggagagtgtacaggggcctctgcctccccctcctgctgtggtttctgtgggcctaggtccccagggcatcttgcctctctttgggtggtggatctttggtctctggctgcttttaaagatttttcttagcactggtttgcagtgatttggtttgtttgctctgttgtggggttttttttttatctctataaagaattttttggatttttggctttagactttcatgttctttctacttggaagatttttctgtaaagaaagccacaactgggttgtgttgaatttcttggatttggggttttagagtttatgttctccttggagacttttctgtaaagaaagccacaacagccgggtctggtagctcatgcctgtaatcccagcactttgggaggccgaggcgggcagatcacatgaggtcagggattcgagaccagcctgaccaacatggtgaaaccccgtctctactaaaaatacaaaattagctgggtgtggtggtgggcacctgcaatcccagctacttgggaggttgaggcaggagaatcacttgaacctgggaggcagaagttgcagtgagcagagatggcgccactgcactccagcctgggagacaagagcaagactccaactcaaaaaaaagaaagaaagaaagccacaacagagttatgttgaatttcttggatttggggttttagagtttatgtttttgtttgtttgtttgtttgttttgagatggagtcttgcctctgtcgcctaggctggagtgcagtggtgggatctcagctcactgcaacctctgcctcctgggttcacgccattctcctgcctcagcatcccgtgtagctgggactacaggcatgcaccaccacgcccagcgaactttttgtatttttagtagagacggggtttcaccgtgttagccaggatggtctggctcgtgatctgcccgcctcagcctcccaaaatgctgggattacaggggtgagccaccacgcccagccgagtttatgttctacttggaagattttcagccattatttcttcaaatactctgtctcttctggtgactgagatcttattatatttacgttagaatgttagattttgtatcagagctaacttagtatctgttcttttttttcccccatcattttctatgtttcactttggacatttccctgtgagggctcttcaagttcattgatctgcttctgcagaatctaacctgctgttaatctcatctactgtatatcagatatatattttttgaactttagaagttctcttttggcatttttaatatcttccatctatttcctggtcatctttgtgtttttcttttttgagacagggtcttactctgtcacccaggctggagtgcagtggcacagtcagagttcactgcagcctcaacctcttgggctcaagtgatcctcccacctcggcctcccaagtagctgggaccacaggcacttgcaaccacacctggctaatttttgtatttttagtagagacggggtttcaccatgttgcccaggctggtctcaaactcctgcgctcaaggaatcctcccaccttgtcctcccaaagtattgggattacaggcctgagccaccgtgcgcaacctatgattttggtggtggtgttttttgtttttctgttttttaaatattcttgagtatatttgtaagctttagatgacctgttttaagttatttaatctatcaacaccattatatctgttattacggccactgtttctgttgattacattttttttcctgcccatagggactttttttttcatgcatagtaatttcttattgcttgacattgtgaattttgctttcttgggtaccgaacatcactgtgttctttcaaagtctattgggcattattctggtcacagaaaactgaggatcagtttgctcctctgatactagcttttatctacatataactatataccttgtgttcagttgccttattcaggggctcatttagttaactactaaagttatagtggttgacttctgatggtaactcgccagcaccctggcatgcgttctgtccactgtgggaaggggaacatgcagatctcccagccctgagtggtccacaatctagtctctccttccctgggtggcttcttctcaggcacctagagtcagtctcagcagacactggacatgtcttctgcaaggatccagagtcctccaggcagctgcttctcccagtctctgccctgcacttggcctctgggagttcctgcctgtggttctcaacagagactacagagctctacagggtcctctgcccctgctgtagctggaggctgtccttacgcagtgagctgaggccacagctagtctcactgcatgtgcttggcggcggggacaggagtgattcattcatcaggtagaggaggaaccctttactctgggaaaatctgtgcctgggttggggaaggacaaatgagccctgtgtgaatactgactactccctggagcccacagtctggtggagcaggtgacagcagggacctaaataactatcaggaagcatgaggtcccaccactgtcacctcccccacctccagagtggctgtgctggctccagagatgtcatccctccatatttgactgacagagggaggctgtgcagtcccaaggctccaggtcatggtagtttggccaggataatatggtttgcttaaaatcaacattgagggtaatgatcgtactaatcagagcatgtgtttaaagttctgtgttttaagcactttccatacatattaacactttcagttcacacaacaacctatgcaggaactgtgattatcctgggcagttttaaggatgtgggtgactcagagaggaaagaagaggttactcgggttaatttttgacgagaaatattagcaggttttatgctcaaacttggtgtaaagcaaggagcctgaatcacaggtgggtgagtcacaagacagggaaaccccgccaatggctcatgtccgggaggaggcagggtccctagaattcaatgggacaagaactgaaataagccaaacccctgacctcccttcttcttgttttccttctctctcttaaccatgcccatggacacccccatgagcccatttctgtggcccaacacagctgtgcatctctggccacacgcccattctccctcaatcagagaggcccacggacggcacagcctcgtcctgcacagcagaaagagtgaatggtgatgaatggatctatattatttcaactctcctacattttgtaatcatattacaatattaattcagcagtacctctcttgtttttactcccctcccccattacactggattcctgtctgtctgggattctgtctgtgtgcactctttcctctatgtccactactgtccctgccaccgatggcatttgtcacctctgcctgggcagcccctccagactctttgcaagttcatggactttggggttaatgatggctgtgcctcagctcctgtgaatggaaactgtgctaaggaaaggaagggccgtgccatgttcccgatactccacggctccttgcatatgcggtcgccaggcgcctacatgccttccatgaatgaatgaatgagtaacgtggattctaggaagctgcactaacccagacgttgtgtcctcagcctgctcatagagtgtgttaaacgtgagaggtggggagtgtggcaggcaggctgaggacagaacagaggatctgaatagagtacggaggatcacccaagtccagagtcaccaaggccattgtcaagttttccccggggacatccctcatcagatccacccattaaagatcattgttcacccagtggagagtggactaggtgggtgcactcaggtgtggcctggacagcattcgggatgggtcctagtggttagggtgagggtcaggttgcattatcgtgaaggaggcaagtggcagctgaggcagatctgagggaaatgatgataacgcaggccggtgatgcaatgggtttggtaagaagaggaaagaggtttgtggtggattctagtgtttctaatctgagacttgggtgaggtcattaccaaataagaaagagtaaatgggcataaatggctttaagaattaggaacctgaatgtgctattggagacagtatgggcacgtcattgctcatagacctgcagtacacaaaatgctaaaagatttcaatctgaatagagatgaaatgaaatggaaacatggatttttttttttttttttgagacagtttcactgttgctgcccaggctggagtgcaatggcgcaatctcggctcactgcaacctctgcctcctgggttcaagcgattctcctgcctcagcctcctgaacagctgggattacaggcgcttgccaccacacccagctaatttttgtatttttagtagagaccgggtttcaccatgttggccaggccagtctcaaactactgacctcaggagatccaccgccttggcctcccaaagtgctgggattacaggcatgagccaccttgcctggctgggaacatggatcttaaggaaagaaggaagatcatcaggaatagaaatatgaatgcacatataaagaatgattatttcctcttaatttcttgaaaatattcactatcaagtaatataacactttgtagggtttgtaacatatgaacatgcctgagacaactatagcagaaagaatgagtagtggagatgaatcaatctgtattatttcaagtctcctacattttataatattaccatattaattctgccatacaactcagtaatgaaaaggaatggagtactgatgcatatgaaaatatgaccgaatttcaaaataattatgctgagttaaagaaaccagacagaaaagcatatatagtatctgattccatctatgatatttatagccagaaatggtttaattaaaaaagaagaaggatcttaaatcaacgagctaagtttacaaatgtaggaattagaaaaagaatgaaccaaacctagagttagcattataaaggaaataattattagaagagaaataaataaaacagagaatagaaaaacagtagaggccggatgtgatggctcacgcctataatcccagcactttgcgaggccaagacaggaggattgcttgaagccaggagtttgagaccagcctggatatggcaaaaccctgtctctacaaaaaatataaaaagcagcctggcccgggggagcacacctgtgatcccagttactcgggaggctgaggtgggaggatcacttgagccccggagatgtaggttgcagtgagccaagatcacatcactgcactccagcctgggcaacagagtgagactctgtctcaaagaaagaaagaaaaagaaaaaagaaaaaccatagagaaaatccacaaaaccaacattgattcttcaatactattaattaaactgacagaattcactagtgaattctaacaagcttttaatgaagagctaataccactacttctcaaactctttcaaaaacttgaagagaagggaacctttcttgactctttctgtaaggccagcattgctctgatacccaagcagataaagatattacaagaaaataaagctatatcccagtatccctaactgatgcaaaaatcttcaacaaaatactatcagagagaattcaacagtaccttagatggattatacaccatgaccaagttggatttatttccggaatgcaagaatgtttgaacaaatgaaaactgaacaatgtaatacattgcattaatagaatgaagggggaaaaagacacatgatcatctgagttgatacagggaaagcctctgataaaattcaaagccctttcatgatgaaaacacccagcaaactaagaatagaagaaaacttccacaacatcataaaagccatgtaagaaaaccccacagctaacatcatactcagtgttgaaagacggaaagcttttcctttaagattaagaacaacataaggatatctacccacctttgccactcagcatagtactggaagttctagccaaaacaggcaagaaaaagaaataagagcatctggactgtaaaggaaaaagtaaaataatctgtgttttcagatgatatgatcttactggtaaaaaatccaaaagatttcacaaaaaattaaactgccaaaaataaaataatattaaatttttaaaattttgaaatttattgttgttcagtaaaagacagtacagattgcaatctgggagatttcaaaccaagtggtaagaaacttgccttacagcaggtatagtacaggctataaaggaggatgtattttgacaatttcatgattgacttataaatttatattctttttaaaggcaatcagagctgtttaagctgatttttctatagctgcttgatttaacttcactgaaccatattatgtcatgatgaaggtgtaaaacttatattttgtgggattttttatgattatagctaatgtttcagggatatcaggatgtcttaagttttggctacatggttatgggtaattgccgtggggtatatctaaactgtgtttttaatttttatttagtagtactaaaatgaattcatcaaagaagcggaatacaaaatcaactggaaaagtcaattgcatttctatacactaccaatgaacaattcaaaaaaagaaattaggaaaaaatccatttacaatagtatcaaaaataataaaataggagtaaactcaccaaggaggtggaagactagtacaatgaaaactataaaacattactgaaagtaattaaagaatacaaaaataaatggaaagatatgccatgattatgaattataagactaattatgtcaacatttcctaaagtgatctatacattcaatgtaatctctatcaaaatcccaaggacatttttgcagaaatgaaaaaatgtatcctaaaattcatatggaatttctagggaccagaatatccaaaacaatcttgaaaatgaataaaaatgtagtaggattcacacttcctgattttcaaaacttcctacaaagctgcagtaatcaaaacaggatggtactgacataaaagcagataaatcgatcagtggaatagaatagaggagccagaaataaacactcacatatatggccaaattatttttcacaaggatgccaagactgttgaatggaggaaagggccgtcttttcaatgaagggggctaggagaaccggatatccacattcaaaagaatgaagtgaaccttagcctaacattgtatttaaaaaatagctaaaaacaaataaaagatgtaaatgtaagtgctaaagctatagaactcttgaaagaaaatataggataaaaattctgtgacattggatttggcaataatttcttggatgtgacaccatggacataggcaacaaaagaaaaaataaacattttggacttcttgaaaatcagtaactcttgtgaatcaaaagatactattaactggataaaaaggcaaaacccacagaatgagagaaaatattttaagttatatatctgataagggcttaatatctaaaatatataaagaattcctacgatctaacaaaacaaaaacaacccagttaaaaatgggcaactgatttttataaacatttctccaaagcaaatatacaaatggtcaataagtatatgaaaagatactttaatcactaatcattagggaactgctggtcaaaacgacagagataccatcctatacccatcaggatgactattataaaaaacacacacaggccgggtgcggtggctcatgcctgtaatccccacactttgggaggccaaggcaggcggatcacgaggtcaggagattgagaccatcctggctaacatggtgagaccccgtctccactaaaaaaaaaatacaaaaaaattagcccggcgtggtggcaggcgcctgtagtcccagctacttgggaggatgaggcaggagaatggcgtgaacccaggaggcggagcttgcagtgagctgagatggcaccactgcactccagcctgggcgacagaacgagactctgtctcaaaaaacaaaaacaacacacacacacaataagcattagcaaatttgtagagaagttggaaccctcgtgccctgttaatgggaatgtaaaatggtgcagccactatggaaaacagtatgatagttcctcaaaagtaaaaacaggattagcagatgatccatcattcccacttctaggtatacgtccaaaagaattgaaagcatggtttcaaacagatatttgtacacccacgtttatagcagtattattcacaatagccaaaaagtggaagaaactcaagttggacagatcaatagataatgtggtatattcatacaatggagtattactcagccttgaaaaggaaggaaatactggcacatgctacacaatggatgaacattaaagacatgctcagtaaaatgccattcataaaaggacaaatgaaataggattccacttgaggtacctaatgtagtcaaattcataaaaaccaacagtagaatgttggatgccagcggttgtaaggagggaagaatgggaagatgaaataacttctgaggatggatagttgtgattattgcacaacaacattaataaatgtagtgtcactgaactatgtattttaaaagattaaaagataagtttcatgttatatataatttaccttagttttagatttaaaaaaacagcatttattttagtcactataacaattacacataaaatggaaatattgttgatttaaaaagccaatgcacaagctgggcacggcggctcacacctgtaatcccagcactttgggagggtgaagcgagcagatcacctgagattgggagttcaagatcaccctaaccaacacggagaaaccccatctctactaataatacaaaattagctgggcattgtgatgcatgcctgtagtcccagctactcgggaagctgaggcaggagaatcgcttgaacctgggaggcagaggttgtggtgagccgagattgtgccatggcactccagcctgggcaacaagagtgaaaatccatctgaaaaaaaaaaagccaatacacaattaaaatgggattctaaaacatactcaattaacattaaatatacaggtaagaaggaacaggtaaaaaatagaatggacaaaaattggtaaaattatagaactattttggctatagtaataattacactaactgtaaatccaccaaacactataactcaaaggtagatatggttagaaggatgaaaaagcaagacttaactacataatgtttataagagatggaatttttttttgagacagagtcttggtctattacccaggctggagtgcagtggcgagatgtcagctcactgaaacctcctcctcctgggttcaagcgattctcctgcctcagcctcccaagtagctgggattacaggcatgcatcaccatgcccggctaatttttgtatttttagtagagatggggtttcaccatgttggccagtctggtctcgaactcctgacctcaggtgatctgcccgcctcggcctccccaagtgctgggattacaggcatgaaccattgtgcccagccaagagatggaatttaaaagcaaaatgcaggtatagtaggagcaaatggatgaaaatagatataccattcaagtaataagcctaagaaaactgctgtggctatcttaatatcatatgaggtggattttaaggtaaagaatattataagacatgaaaagggacctttgtagtgttaagagagttaattcatctggtagacataataatcataagatatatgtcctcaataatagagcttcaaaataaatgaagcaaaaatttacccagcactttgggaggccaaggtaggcggattcacctgaggtcaggagttcaagaccagcttagccaaaatagagaaacttgtctctactaaaaatacaaaaatcagccaggtgtggtgtcatacacctgtaatcccagctactggggaggctaaggtaggagaatcacttgaacccaggaggcggaggttgcagtgagccgagatcatgccacagcactctagcctgggcaacagagtgagactccaatctcaaaaaaaaaaaaaaaaaaaattacagaattcagaggaaattataatacactgttctaagcaattaatggaatggtttgacaaaaatattagtaaagtcataaaagggccaggcgcggtggctcacgcctgtaatcccagcactttgggaggctgaggcaggtggatcacaaggtcaggagattgagaccatcctggctaacacagtgaaaccccatctctactgaaaatacaaaaatgagccgggcatggtgggtggtggtgggctcctgtagtcccagctactcgggaggctgaggcaggagaatggcatgaacctgggacgcagagcttgcagtgagccaagattgcaccactgcactccatccagcctgggcaacagagtgagactccgtctcaaaaaaaaaaaaaaaaagtcataaaagatctgaaccaccttgacttaattgacatttataagaggacacatgcatctactgaaaactcattctcttctagtgaagatggtaccctcactcattttatagcccatattctgggctataaaataagtctaagtaaagtctcttttaaaaaagagaactcatatatgttctctgatctcaatgaaattcaattggaaatagataacaatgtctagaaagacctccaaatttggatgctaagcaacacacttataaataatccatggttcaaaggagaaattaaaagctaatacaaaaatatttcaaaatataatgaaggtttaatgcatcaaaacttgtgggaagctattaatatggttctcttttttttttttttgagatggagtcttgctctgttgcccaggctagaatgcagtggcacaatcttggctcattgtaacctccacctccctggttcaagggatcctcctgcctcagcctcctgagtagctgggattacaggcatgccccaccatgcccggctaatttttgtatttttagtagagacagggtttcaccatgttggtcaggctggtctcaaactcctgccctcaaatgatcgcccgcctcggcctcccaaaatgctgggattacaggcgtgagccacacttaacttcacatttcataattcctgagtcttatcaggcaaaaacaagtcctgaaaaaacaaagtaaatctacttattatagtagggcagataatacaaagttgggcattaaggtaatatcgtatttatagttttaaagctgatgactctataaggacagtatgtgcttcagtgaaattataaacatgaaaactctgctttcagttcttttggatacatacccagaagtgggattgctggatcatctggtaattctacttttaattttttgaggaacaaccatactgttcctggaccaaactgagggtcgggctgctatttcttgccacccattaatgagatgccaatgaactgggaagaaagagtttttatttctgtagctggttacagggagaaggcctggaaattatcgccagaccaactcaaaattacaaagtgtttcagagcttatatcctttctaacctatatgtctacatgtaagtgtgcattcatctaaagacataagtgattaacttcttttaatctataactaaggtctgagtcctgaagaccttcctgtggagcctcagtaaatttacttaatctaaatgggtccaggtgctggggtgattaccctgctaaaccatggaggtttggggagttccttcaaacctccaatacccttgtttgtggaggcctggggagtttcttcaaaacccccaataaaacttgtttaatcctaaatgggtcctgttatgaattcctccattattttgtcatgctttaaggcccaggaaaggcctaagcaaaactcttgatgggcttttgttacattccagcctttgtataagggcactggcttttttttttttttttttaagcatttaatagttaacttaagcacttgattagtactgaaacagttgtgatggaggcctgcattagtgaaacctggcctgctacaatccccactgtcaatttgcgcatgatttctatcatgcttgtgtatttatttatcatgagaatcgtagggagatggggtgtcataatctttctggctactttcagctgagagagggtcattgttatggggcaccaaatgcagtactggagtggaggaggttgatttgttcccggtagcactgtctattttaggggcttagagagagtgcctgctgaaacacctagttttcagttcacagggctttaagaaagcaaagcttaggtttcagtgatttccagttagggaaaatggagaaaaaggaaaagaaaaaggaaaaaattgaaaacattttgagacttgcagccagaaaaattagaatttaatccaaactgtagaaaataataaaaactgaaaaacatcgaggaagactagaatttaacaggtgtaactataatttttgaaacataatttttctctcttgtttcccatttttattaaaagacaaatcatggtaggactggtttgctttattatacttggcctaattacttatataccgtgcagcaagaataattattttttacataggcgttttaaatgggctttgatggaactttgttccatagcaggaatctgagataagacctttttaaagccgagcccaaccatggatttataccatcaaatacctatgagttgggtgaattcctctcttcttgaggttccaagataacttggggttcctggcctgtcagaaagtgacattctttacttaccacaggtcagaaaccctgtacagggtctatgtacacaaattatgaggccagtttccaagggctttcttggcttcctaagtcaagtttgattccttaaaggagagcaaagtcaaagccttggtaaaataaccagtttttccaattgtgtcctgttacaaaagaaaacagattcttactgcacttatgcaaataactatattgccataacttaagaatactcacagtttcgaaattctggagaaaatcaggtagagagaaacaaatatgctccaaattttgttcataggagtatactgtacttaaatgttaaaaggtgttaatagctcaaaagaaaagtttccttgcctctgaaaagcaaaacaaaggattagcaacattttaagccgaaagtcaaaaagatcacttcagtctcctattagttcagttcatgcagttaattcctgtcctgtttgatattaatgaacattttaactcttcaagagtcatcaacgtttttcctctattttgatgtcacaatctccaaagttatcagaaacctgcattcaagagcacctgttagagctttacagctgattataaaaccaccttctaaagaggaccaaaacaagacagacaacaattatttatggaggacaaaaggttttagggtagccatagttaaagacacaattgatgacaagggtatctgttacctctgtggcacacaataattttaacataacaattataattattaatgataacatacactaagatatatcagaattataggagtcttccataactttggaacacataccaataatatatttatgcacatacagcccaaagaaagccaaacaccatttcatgtttgacaatgcttcctgtataattttatatcaaataagccacatttcacctttacattagtgtactattaatgttaaatccaatttttaataaaaccttatagacacatttacccaattttaatgtttgaccataaagtaagagttttatagacctttcataactctttacaatttttgttaaacagaaggttagtgctctaagagaaacccattgtgcttttattttaatgctcaatttacagaaaaactggatgatatccctttaattttagccaatacatttacacacagaattgtctttacaattacccttccacagcttgcttaaactttcatttttattttatccaacttaaaacaatcctttaaccttttaatctagtaaaaaatatccacattctcatgcctccttataatctttttaccaaaagtatattttactttccttacacaacttgcatgtaaactgttttttcaatagtcttaaatacacattacattgttaattcttagcaaccttttcttttggtgaaaaccttggtaaatttgggattttaattatatactaggtatggagcctacgacctagacagaaatgcaggtaaggtctgacttattctagcatctagctccatgtgtcctaggccttacctagctgcaaagcaggcaagttgtacagctaagagtcatagtggcattttataaagcatttaggaggcctaatcacctttaaattgtacaacatttcttgcataaatttcctttcataaattctttcacaacttacacagacaatctctgacatgccttgactttctgacttgttctaaacatccctctctttaaacaaccagttaatttactttaggacaagaatttaccatacaggagcccttcttgtataaattctcttttctttaaaactttttgcatagctaggggacatggctaatttcacatgtccccaggccgtatctagaatttaacagtccaaaataaattgaacactttttaagtcaaagaagcattttatgacctaaagcatttagcaaacctagtatttgacctgcataatttagaccaactatttacatttttgaagatacttttaccaataatctttaaaattctccttatttttataactttctgtatatctctcttatttcctggtttcttttaccttgttttatatataacctttaaataagctttgaataagacaacaattagttacccttggccaggcgtggtggctcacgcgtgtaatcccagcactttgggaggctgaggcgggcggatcacaaggtcaggagatcaagaccatcctggctgacacggtgaaaccccgtctctactaaaaagtacaaaaaattagccaggcgtggtggtgggcacctgtagtcccacctactcgggaggctgaggcaggagaatggtgtgaacctgggaggtggagcttgcagtgagcagtaattgtgccactgcactccagcctgggtgacagagcaagactctgtctcaaaaaaaaaaaaaaaaaagttaccctttaaaaaggacacaatctttagaaagaatgttttcctacgatatatttttattagaaaatacccaaataattagatatctgttgtttaatataactttagattctaaattatgacaagtttacttatgagtatgtatcccattacatttatctaattatttattttaatcatttacccagattatatatgaaaactgcgatagttgtcattaaagttaggaaaccaccattgcaaaattatgaccgagacagtgaaaatgatctgacctaactgactccatcttccttctaacctacaaggtattcttgtttattaacttagtttataatttagctttgaaacaaatgtgataacagtcctttcccagaacaaacttccttcatgtctgtggactagactgcttaaggccagaagattagaagttagggtattttggccaggcacggtggctcacgcctgtaatcctagcactttgggaggccgaggtgggcggatcagaaggtcaggagatggagaccatcctggctaacatgatgaaaccccatctctactaaaaatacaaaaaataaccaggcgcggtggcgggcgactgtagtcccagctactcgggaggctgaggcaggagaatggcgtgaacccgggaggcagagcttgcagtgagccgagatcgcgccactgcattccagcctgggcgacagagcgagactccatcttaaaaaaaaaaaaaaagagtattttactaaataattcaagatgtaactatcttcattaaaacaatattaatgtttcatttatttaaaaattacacatgcaaagattattctgtttgcactgaattatagttttgtagcctctatgccagattttgacaccttataatatttggcagagataagtatgaaattgcttgatcaataaatgcaaactaaaatgtatgctggaaactcttaagacatttctaatattactttaccaataatttttaaaaccagcttacttattaaagattttaagtcacataaacttgaaaaagcatttgactagtctttccttttttctgttattcaagtgcttttttctttgagccatttaattagacctcttttgtatatcttcagtagtgaaacatggtgtacacaagacaaatacataagtgtattatgcatgccaatagaagtacattttatagattcgtaagacctcatttttcagtctccctctactgcctaggccagagtacagtggcatgatctctgctcactacaacctctgcctcccaggtaaaagcaattctcgtgcctcagcctcccaagtagctgggattacaggtgcctgccaccatgcctggttaatttttgtatttttcttagagatggggtttcaccatgttggccaggctggtctcgaactcctgacttcaagtgatcagcccgcctcggccttccaaagtgctgggattacaggcatgagacaccacgcccggccttaactggatgtttgagctctgggtggagcccatactgaatcctgggttttcaaaaagggagaattattatgaggctagaccatgtgatgcttttacagtgcacttaaacaattttttcccaaagacatttctaagtgtctaaattacactttttctttaaaaccccagagtagcttctgtttaatagctattaatgaagaaaacagaattcagtcaactgagaagaaaaaaagttttgctcaaaaagataaggccctaggagagagagaaataaaaccaaaaacacgaaggccttttaaaggccttcacgcccccgtgcgcacacacacacatatgcacatacacattttggatgttagcttttaattaagctgactcccaatcattgagcttcaaaaaatctttctccttcccagaggcctctcagcagagatggacccaatacttcccattttcaagtttacatggtatcaaaaggaacaagacagacacacaaacaaatggaaacatttcagaaaaacccaaggggaagtgcactacggcaaaacagactctcaaaactaacgcaaaacctgatatcaaccaaagggaaagtgggtgtatgagccagccctgttgcttcccttggcagtaccggataaatggcttaaccagcccaaatgggaaaacaataggctcctggcctaagatcccattgactcaccctttgagcacgtccgctccttatctctgttcttccccagtagagaaagggacgtgtagatttgcacataaacagccctctggagggtcccctggggaaacctcacctgacagctgctgggatcctcctgaagactgtctcatcgcaagctaccagccgctgaacgcggcactgtccttatcttctggctggcgacttttttgttcccagaccaaactgagggtggggctgcccaataatgagatgcaggtgaatctcgctgcccaataagaagatgcaggtgaatctcgctgcccaataatgagatgcaggtgaatctcactgcccaataatgagatgcaggtgaactggggaggaagagagtttttatttctgtaactggttacaaggagaaggcctggaaattatcaccagaccaactcaaaattacaaagcttttcagagtttatatcccttctaagctatatgcctacatgtaagtgtgcattcatctaaagacataagtgattaacttctttgaatctataactaaggtctgagtcctgaagaccttcctctggagcctcagtaaatttacttaatctaaatgggtccaggtgctggggtgattacccttatcttgtctcctgctaaatcatggaggtttggggagttccttcagccctcccacacacttgtttttggaggcctggggagtttcttcagacccccagtaaaacttgtttaatcctaaatgagtccttgttaagaatttcttcattattttgtcatgctttaaggcccaggaaaggcctaggcaaaactcttggtggggttttgttacatcccagcctttatataagggcactggctttttttagcttttaatatttaacttaaccactcagtcagtactgacacagttgtgatggagggctgagtgaaacctggcctgccacgatactgtttttcccagtgtgtgttttacattcccaccaacagggcacgaaggttccagtttcttcacacctcaccagcacttgttattttccatgctgttgtttttaatatagtagacgttagtggtggtgagcatcttttcatgtgcttatgggccatttgcttatcttctttggagaaatgtctttcaagtcctttgccctttttaaaattttttaaaaatttttattgtaaattaagaaattacggccaggcacagtggctcatgcctgtaatctcagcactttgagaggctgaggcaggaggactgcttgagcccaggcgaacgttcaagaccagcctgggcaacatggcaactcccaataaattgtatgtatttatggggatttatagggtacaaagttatgttatgatttatgaatacaatatggaataattaaatcagctaatatgtccaacacctcaaatacttaacatttttatggtgagaacatttgaaatttattcttttagcaattttgaaatgtacaatatgctgttattaactacattcattgcactgtgcaacagatctcaaaaatcttattcctcctgtctaaccaatggtttgtacctttgattatcatctccccattcccccgtgcccagactctagtaaccaccattctattctctgcttctgagttcagttgtttttttttttttttttttgacacaaaaatttcacttttgttgcccaggctgtcgtgcaatggtgccatctcagctcactgcaacctccgcctcccgggttcaagtgattctcctgccttagcctcctgagtagctgggattacagatgcccaccaccacgcccagctaatttttgtatttttaatagaaacagggtttcaccatgttggccaggctggtctcgaactcctgacctcaggtgatccacaccctaccttggcctcccaaagtgctgggattcaggcatgagccaccgtgcccagcctcgttgttttcaatttcatgtatgaaaacatacagtatttctctttttgtgcctcacttatttcacttagcatgatgtattccaattccatccatgttgtttcaagtgacaaaatttctatctttttaaaggctgaatagtattctgtattgtctacataccacattttctttatccatttatctgttggtggacacaggttgattgcataacttggctgttgtaaatagagctgcaatgaacatggaagtgcagatatctccttgatatactgatttcaaatctttttggtaaatacccagaagtgggattgctggagcatataataattctatttttagttttttgaggaagctccatactgccttctgtaatggctgtactaatttacattcccaccaacagtaagcaagggttcccttttctccatatcctcaccaacacttgttatcgtgcatctttttgataatggccattctgataggtatgagatgatatctcattgtggttttaatttgcacttccctaatgattcgtgatgttgagtttttttttttcaaatatctgttgaccatttgtgtgtcttctactgagaaatgtctactcaggtcccttgcccattttgtaatcagattattttttctctttgaatagaattatttgagttccttatatattttagatattaaccccttatcagatgtatggtatgcaaatattttctcccagtctgtagcttattgcttcactctgttgtttcctttgttgtgcagaaactttttttttttttttttgagatgaaatttcactcttgttgcctaggctggagtgtaatggcatgatcttgactcacggcaacctccacctcctgggttcaagtgattctcctgcctcagcctcctgagtagctgggattaccggtgcatgccaccatgcccagctaattttgtatttttagtagagatggggtttctccatgttgatcaggctggtcttgaactcccgacctcaggttccgcagaaacttcttatgttgatataattccatttgtctatttttgcttttgttttttgcactttaggggtcaaattttaaaaaatgttgcccagataaatgttgtgtagttttagcccctgtgttttcttctagcagtttaatagtttaaggtcatatatttaagtctttaatccattttgagttgatttttgtatatggtgtaagataagggtccagtttcattcttgtgcatatggatatccagctttcctaacaccatttattgtggagacttttttttcccactgtgtattcttggcacttttggcaaaaatcaattgaccatagctatgtggattcatttataggctctgtattttgttccattggtcaatatgtccatttttatacccgtgccatgctgttttaattattattgctttgtagtatagtttgaaatcaggtagtgtgatgcctccagcattgtactttttgatcatgattgccttggctatttgtgtttttttttttttttttttatggttgcatatgaattttaggattgttttctctatttctatgaaaaatgatattggaattttgatagtgattacattgagcctatagattgctttggatagtatggacattttaacaatattagttcttccaagtcatgaacatttattttcatgcatttgtgtctctttccgttttatttgtctcttctgttttgttcattagtgttttacggtttttaacatacaggtctttcacttccttagttaaatttactaatttttttttgtcattgctcttaataggtttgttttcttaatgtctgtttcatatagttcattattaatatatagaaatgctactgattttcatatgttgattttgtatcccacaaccttactgaatttgtttacaaatttctaacagttttttggtggagtcttcagggttttctatacagaagatcatgtcatcggcaaatagacaattttacttcttccttttctatttgaatacctaataattcttttctttttcttgcctaattgctctggctaggacttccagtaccatgttgaaaagaggtggtgagagtgagcatccttgtgttgttcctgatattaaaggaaaagctttcagcttttcactgctgagtatgatattagctgtaagcttgtcatataaggctttttttgtgttgatacattccctttacacctaatttgattagagtttttatcatgaaagaatgttgtgttttgtcaaatgctttttctacatctaatgaggtgatcatattgtttttgtcctgcattttgttaatatggtatatcacatttattgattttcatatgttgaaccatctttgcatcccaggaacaaattccattttatcatggtcaatgattcttttaatgagctattgaatttggtctactggtattttattgaagatttttgcatctgtgtttattagagatattggcctataattttcttttcttacagtgttctattctggctttggtatcaaggtaatgcaagccttgtaaaataagtttggaagtagtccctcctctgtaatttatttgggaaagtttagaaaggattggttttagttcttgtttaaatgttttgctgaattcagcagtgaagccttctgggtcctgggtgtttctttgataggagacttttcattactgattcaatatccttaatcattattggtctgttcggattttccatttcttcatgattcagtattggtaggttgtatgtgtctagaaatttatccatttcttccgggtggttcaatcctttggcatataattgttcataatattttcatatgatcctttgcatttctgtggtatgcattgtaatgtgtctcatttttttttttatttgagacagagtctccctctgttgcccaggctggagtgcagtgtgacaatctcagcttactgccactttcacctcccaggttcaagtgatttttgtgccccagccacccaagtagctgggattacagatgcacacctccatgcctggctttttttttttttttttttttttgtattttattagggacgaggttttgccatgttggccaggctggtctccaactcctggcctcaagtgatccatccgtctcggcctcccaaaatgctgggattataggcatgagccactgcacctggcctcctcattcatttttgatttaatttatttgtcttctttcttttttcttagttagtctagttaaagtttagtgatttcatttattttttcaaaaaactaacagaattttgataatcttttgtatttttttcagtctctatttatttttgctctgatttttattatttcttttgttctgctaactgtgggcttagtgtatcttttcttctatttccttgaggtacaacattaagtcttgtatttgagatctttcttcttttttgatgtaggcgtttattgccatttcctcttaaaactgcttttgctgcatcccatacatttggttatgttatgtttccatttcattttctaatatactcttaaaattcccttttgatttcctctttgacacattggctattcaggagcttgttaccattcaagttctttgttcatttcttaatcacattgttggctttttgttgttgttgttgagttggagttttttatatattttagatattaaccttttatcagatatacaactagcaaatgttttcctcttcctgtgggttgccccttcactgttgatcatcattggatgcacaaaagtttttaatttttacatagtgcaatttatctactttttttcctatattgcttgtgttttggggatcacattcaagaaatcattgccaaatccaaggtcaggaagaatagttcctatgttttcttctaagttttagggttttcacttttatgttagattttggatccattttgagttaatttttgtatacgtgtaagttaaaggtccgaggtcattgttttgtgatgagtcaatgtctagatttcccaagaccatttttaaaaagattgtcctctcaattaaatggtctttatacctttgccaaaaattacttgatcatatacagtcatgcaccacataacaacatttctgtcaacaacagactgcatatgtgatggtggctccatgcaattatgtaacatgctacacaggtttgtagcctaggagcaaaaggctataccatataggccaggtgtgtcataggatacaccatctaggtttgtgtaagtacactcttctgatgttcacacaacacaattgcctaatgaccctttgctcagaacaatgttgagcaatacatggttgtacgtgcaagttcatttctgggctctctggtctatatgtcaggcaccttttaaatcagaagttcactatttaatgtttgatcctgtatcccaattttttaagtttgctatattataacccccatttataaaaatgtgtgtctgtgtgtatgtctgtgtgagagagaataagagaaagagagaaagagagaataggcatacctatggaaaaatagtggaactaaatgagacaaaatattaatggatgctatctttagctgagaatatcacgtgtggtctgtgtattcttgtaaaaactttccttgcccacattttctggaatgaacatgtttagaagagttttgcaggtgtatgttacttggccttccctgaaatatgaagggacaaacaaacactaaaggatgtttgagaggtgagagctgcaagaaagatgagggttctgtttagcttgggtgcctgggctcaagagaatgtgagtggatcctgggaggggtgaggtctggaagccactcatgcccatccctgctttgtccccacaggtctcagctgagtctgctctgatcacccaacaagacctagctccccagcagagagcggccccacaacaaaagaggtccagcccctcagagggattgtgtccacctggtatgttcaagatgggtctctaatccttgcccctcctccccttgtctccatgagcttccagtctgtttcctttgcacttccttgttctttattccacagagaggcattgggtgcctccagttcaaggctctgtccttctggagccttcctgctaggatggtatcaagacacacaaatgaatgagacagccaaagaaactgataggaaccttgagagagaattgagtgggacagagatggggctggtgaggcctccaggcaatggtgactttgggctgacatccggaggagggcagggccagaggttcagagagccaggaagagtgctcctaggagggttccactggaacaattgccagggggcaagagttggagaagatggagcaacagcagggggctgctgtggggagtggagggttaggaagttagagagacacgtggggtcagatcccacacagatgaagctggattttatttcatgagtgatggatgtccctgagaagttttcagcagagggccaccagcatcggatgtacatcttgagtgcccactcctggactgaaccggagcaagacaggaagcaggtggagggccttgagtgtgaggcgctcccctgggatgttatgtggtgtcccgtaaggtcatttgagcccccagagatgcagcaggaacctggcctgaagtgtgcttgactgttgtgttcgcctcgcacttcttcccccttttcccccatgtgtatgagttaggaattgattgctgcatgaaggtttccagggcaggcaagtgtggcaagcagtggcttttaaaatccatttacaaagttgcatttcttttccatgactaagggccacaggaaaggcttgcctgagggcaaaccctcacattgcacatgtgggcttgccaggagcagagcatggagaaggaagaacccagcgtgaagcagacacaaactcatctgtaaatgctcctattgctgtggtccagggtcaagaccaggaagcaggacgggaataggaaggactcaagacatatttggggtgtggatggatgacgtgtggggaatgaggacaatcgaggcaccaaattcaactgctcagggtaacttggcctctgaggggacagtgtgtggcagggctagcagtacacatttggggaccctagcacataggtgatgcttgaagccgctgtcttgagtgtgtccacctggaagaagttgtaaatactgaggaggggcacaactgagcccatgaggatttgaagttggagacgataggccagggagacaggactgcaatgggctgagcaggagcagttggagaacttccatcctagaggagagatggcccttccagccacagggagcaggccatagcaagtgtcaaggactgagatgtggaaactcctcgaaatgtgcatttctcttcctgtgaatgaggtcaagaatctgttcatgacacagacactgtttgtacactggttctcctaggttttcttcactcctagtaagaggttaggttttttttttttttttttttaaatcattgagtcacatgaattcttacagattagggaaattatacattgattgattgattgattgactgattgagataggatttcactctgttgcccaggctggagtgcggtggcaggatcatagctcactgtagcctcaaccacttgggctcaagcgatcctctcacctcggccttccaaagtgttgggattacaggcgtgagccactgcgctgggtccaaaattctaataaaaattcccatataacgccgggcgcagtgactcacacctgtaatcccagcacttcgagaggccaaggtgggcaaatcacttgaggccaggagtttgacaccagcctgaccaacatggcgaaaccctgtttctactaaaaatacaaacattagctgggtatagtggcgtgcctgtagtcccagctacttgggaggctgaggcaggagaatcgcttgaacccgggaggcagaggttgcagtgagctgagatcacgccattgcacttcagcctgggtgacagagtgagaccctgtctcaaaaaaaaaaaacaacaaaaaaaaaattatcatatatctttgcagtcattttgtggtttcctattttgtaattaagtcattgagccacatggacttcattttgtagtaagaggagagtgaggaagacacattattatttgacagccacctttttggttgccccaacactattattaaataatcacgtttttatcagtgacatgaatcactatgattatgtatgatacttacattattaagtaaggtttgtgtaatttggattttttagaatgtctttcaatattaataaaaataattcaggaatcttgtggctagcatataggtgattatggtctattttttgcgtttgtttttactcattctgccactctctgccttttaattgcagagtttaaactattttcaattaacatagttattgacaagaaaagatttgtttctgctcttcagttatttgttttctttatgtcttatatatattttgttcctcccttatcaccttttgaaaaaactttagtttatttcttggcatgtaccattttcactcacttcttttcttttctgcatattttaaaatatattttctgtttttcttaaatatatattttgtgtatatatatttaataaatatatattttgtatatatatatttaataaatatatattttgtatatatatttaataaatatatattttgtatatatatttattaaatatatattttgtatatatttaataaatatatattttgtatatatatttattaaatatatattatatatatttaataaatatatattatatatatatttaataaatatatatttaaatatatacttagtatatatcttaaagatacatatcttaaatatatatatagatatatatatattttttgagacagggtctgctctgtcacccaggctggagtgcagtggtgcgatctcagctcactgcagcctatggctgctgggtttaagcgattttcctgcctcagcctcctgagtacagggagtagccaccatgcctggataatttttgatttttagcagagacagggttttaccatgttggtcaggctgtctcaaactcctgacctcaagtgatccacctgcctcggcctcccaaagtgttgggattacaggtatgagccacgcacctagcctaaaacttattttcttactggtttccttgaagattacaattaccttcttaagtatctaaacaggtagttttataataccggcagaatttcattgcaatccaaatactgtgctcctgtaccactccatctctccagctttctattgttgctgtcatagatcacatccttgcacgttgtgtgaccactgacgtcgatcttaaggacatgtatgtgtatggagcaaggttgacttgtgatggttgattttatgtgtcaacttggttacccagatacttggccaaatattatcctagatgtttctgtgaaggtgtgtttgttgttgttgttttgttgttggttttagatgggattaacatttaaatcagtgggctttgagtcaagcagattacccccttaatgttggcaggtcccatctaatcagttgaaagcctcaatagaaaaaagactgacctccaccaagaaagagggtgttctgccagcaggcagccttcagacctgagctgtgactcttctctgctggcctatcctgtaccttttgaatttgccagcctccacagttatgtgaaccaattccttaagataaatctttatctctctagagcaggggcccctgacccccaggccatggaccagtactggtccgtggcctgttaggaaccaggccacacagcaggaggtgggctgtagatgagtgagcattactgcccgagctctgcatgccgtcaaatcagcggcagcattagacttcataggagcgtgaaccctattgtgaactccacatttgagagatctaggttgcgcactccttatgagaatctaatgcctgatgatctgtcactgtctcccatcacccccagataggaccatctagttgcaggaaaataaactcagggcttccactgattctacgttatagtgagttgtataattatttcattatatgttaccatataatagtgatagaaataaagtgcacaataaatgtaacatgcttgaatcatcctgaaaccatccccatgcccccaactccagtccgtggaaaaattgtctttcaggaaaccagtccctggtggcaaaaatgttggagacccctgctctagagagccctgactaatacagaatttttaaagatttgaaattcttttaaaccatacttgatctccaagtaatggaaataataagattatatttccacctaacataatacagctatcctgtatacaactgaaaacgcactaaccctttctccagaagaggatgcaaagttcttgagtggtgtttactcctttccttgataccctggaacataaatactataaagtgaacaatacttaaatactatgatataaattcaaaatatcttgtgttacataacaaggggataagagaaggaagaaaacacagatattcgcttaacatatatttacacataaacacacacacataacacaataaggaagaaatacttataatgattacagtccttatttccatagctggtcatgtcattgtagctggtatttataagaagcttctttcgctgtgcattctgtattccctgtgccctcactaagcacctcagctggtcatggctctgtgcctggtagagtgaactaacctttattcctgaagggtctgagctataagtggtcctgctttaatagggtcgtggtagttttccattgactttactcacagggcatggtaatactaagagatgccctaaggaatctcctgtattctagacatcctcttccttacgtccattgtggaataacagtccaattttcccttcaatttcccctttgtgttcagaatcagtcaatccagccagcagggtttgtgtaactggttttcgcctgttgattcagaggcatgaggaacccaaagtggccaagtggcagtcttcaagttacacagaatcactgttgtgtctcctcatggaatcattcctccctctgaaactcagagctctagcaaagcataaagcagcaaaaattttgataacaggccactaagggtaatgtggagtggggccattcctgcttccacccctagattcctggacacatgaatcctagcaatggaagaagcaaccgcatgtattggaggataattcagagcatagacagtctcctggagaaccttgttgcagcccttcaaggtactgccacccagctgacattgtaaatgagttttcaaaaagccatatcccaccatcttaccaagccagcagttttgagatggtggggaacatggtaagaccagtaattccatgagcacaggcccattatagtgggcgcttcatttgccatcaagtgagtccctcaatcagaagcaatgctgtgtgaataccatgactgtggataaggcattctgtgagtccacagaggatagttttgacagaagcattgcatgcagggaaggcaagtctatgtgcaaaataagcttctcttccagtaaaaatgctgccccctccatgatagaaatggttcagtgtaataatcaacctgccaccaggtagctggcagactgaccctctgaatggtgctatatcagagactcagtgttggactctgctgcctatagattgggcactcagtagcagctgtagccaggttggccttggtgagggaagtctgtattgttaagcccatacataacctccatccctgccaccatgcacactttgttcatgagcccattgagtgatgacaaggatggctgggaaagaagctgactggtagtcacagaacaggtcatcctatccacctgattattaaaatccttccctgctaagatcactttttgtgaagatatttgtgtcacatggggcacaaatatcttcatggtttttttacccattgagaaaggtctatccacacacctcttccccagacttccttgttatcagttttccttcagagcctctgaccctccagccaaatcattgaccacagctcatgaatcagtatataactacatgtctagccattcttccctcaagcaaaatgaacaaccaggtgtactgctcagagttctgcccagtggcaggatctcttttttttgagacggagtttcgctattgttgcccgggctagagtgcaatggggcgacctcggctcactacaacctctgcctcccgggttcaagtgattcccctgcctcagcctcccaagtaactgggattacaggcatgtgccaccatgctcggtaattttgtatttttagtagagacgaggtttcaccatgttggtcaggccagtctcgaactcctgacctcaggtgatccactcacctcggcctcccaaagtgctgggattacaggtgtgagccaccacacccggcctagcggatttcttttcaccactgtccttcagggacgtcccagacagtggatgtgatgctgcaaacatccacttctaagggttacctgtatgtggtgcagaaccatctgtaaaccttcttctggcaactgaccatagggaattcctcatgaggccataagtgcaggccaggcaaaagaaagtaatattgcaggagtggggatcatgggcacttgggccacttcttcatgtaactttcttgtgccttcagggcctatttaagcccaattttgtatatataccaattacatttgaaaatggaaatggaaactttaggctgtatgtgcccaaacttatggcttggtaggcaaaataacactcagttcacgatgagcagtcaggtcgtagagtaatttggtggcctatggttaaccattcagtctgcactaaggcccagaaacaagccaagagctgtttctcaaaaggagagtagttatctgcagaggatggcaagtctttgctccaaaacctaagggcctgtgctgtggttgacctagagtgggctactaaaggttcaaaacagcattgctgtctgccaccaatacttcaagcaccgttgggtctgctgggtcgtatggcccaagtgacagaaaaatgtctacggcagcctggacctgttgcagagccttttcttgttctgagcaccactcaaaactagcacatttttaggtgacttgataaataggccagagaaacacacccaaatgaggaatatgttgccaccaaaatcaaaataagcacactaggcattgtgtcattttcttggttgtagggaggtgggggtggcagatacaacaatttatcttttatcttagaatatcttagaagagaaggaatatcttatgtgccacatcattcaacaactaggaatttgtttcccagttgttgtccttctactgaggtaaaaggcccttgaaattttgtcagatttatttcccaccccctgacatgcaaatgtcttaccattaagtctagaatagttgctacttcttgctcgtgaggttcaatcagtataatgtcatcagtataatggatcgtcttgtgtgttatcttgtggaagggaaaggccatcaatatccctgcaggccagatgtggtggctcgcgcctgtaatcccagcagtttgagaggccaaggtggctgggtcacttgagaccaggagttctagaccagcctggccaacatggtgaaacctcatctctactaaaaatacaaaaattagttggatgtggtggcacacatgggtaatcccagctacttgggaggctgaggcatgagaatcgcttgaacccaggaggtgcaggttgcagtgagctgagatcatgccactgcactccagcctgagagacagagcaagactctgtttaattaaaaaaaaaaaaatacctgcaaactaaattatgacatagggctgcgagttgatgcatcccggagacaggatagtgagggtatattgctggccttgccaactgaaagcaaactgcttctgggagtctttattgacaggtatgaccaacaaagcatttgccagttcaacacctgcataccagggtaccagggatgtggcgatttgctcaaacaatgaaaccatatctgggacagttataactggaatcaccacctggttaagcgtatgataatccactgtcattcaccaagatccatctgtctttggcacaggccaaatagtcaagttcaatgggcatgtgatgggaatcaccacagatgcatcctggatggtggtaatgatctctgcaatccctccaggaatgttgtattgcttttgtttttttgtgctttacaggcagggtatcactctgtcacccaggctggagtgcagtggcacaatcatagcacactgcagcttgaactcctgggctcaggcaatcctcctgcctcagcttcttgagcagctaagactacaggcatgtactgtcatacctggataattttgtatgtgtgtgtacagatggagtctcactgtgttgcccaggctggtcttaaacccctggcctcaagtaatcctcctgccctgacctcccaatgtgctggaattacagacatgagccaccatgcccatctggtattgcttttgatttactattttttttaagtaaatgcaaatctggtggcttccacctggtcttttccaccataatagtcttcacttcacatgtcagggaatgaaggtggggattgtgccagctgctgagtatgtctattccaattacacatactaaaatgaggaaatcagacaggatgggtgtggggacccactggcccctttctgagatggacttgagcttagtttgagtaatgacaacataacttcaatggtatgcaaacactgtgctcctgtacttctccgtctttcctcctccatcttgttgttatagatcacatccttgtacattgtgtgcccattaacatcaatttgtaattattgttttctgcatttgctctttaaatcatataagtaaataagaggatttacaaaccaaatgtaccataatactgtgctacagactgaattgtgtccccaaaatcatatgttgaagcattaccatccaatgagatggtatttggagatggtgcctttgggaagtaattgggtttagatgaggtcatgagggtggggccctcatgatgggattagtgcctttttaagaaaagacccagacaacttgctctctctcgcttgctcgctctctctctccccccctcttctggtgtgtgcaaggaagaggttacgcaaatgcacagcaagatggtggccatctctagaactatgataaataaatgtctattgtttaagccacttggtctatggtattttattatagcagcctaagtagctgcgtaccagcatttatatttacctaaatagttaccttttccagggttcttttttttttttttttttttttttttttttttttttgagacggagtctcgctgtcgcccaggctggagtgcagtggcgtaatctcggctcactgcaggctccggcccctgggtttcacgccattctcctgcctcagcctcccgagtagctgggactacaggcgcccgccacctcgcccggctaatttttttttgtatttttagtagagacggggtttcaccgtgttagccaggatggtctcgatctcctgacctcgtgatccgcccgcctcggcctcccagagtgctgggattacaggcgtgagccaccgcacccggcctccagtgttctttatctcttcgtatgcctttgagctattatctaatgtcattacattacctcctaaaggattccttttagcatttcacagggcagatctactagtaatgtgctccattacctttcatttatctaagaaggtcttaatttcttcttcattcttgaatgataatgttcctggatatcaaattcttggttgcaggattttgtatgcttgtgtttttgtttcttggcactttaaatatgttacccactcccttctgggctctatggttcctggtgagaaattagctaataaccttattgaggttcccttgtacatactgagtgggccacttgctactttcaggattttctgttggtgttgggcttttgtccatttgactataatgtgtctcagtgtagttctcttttaacttatcctgcttggagatcattgagtttcttggatgtgcagacaaatgttttttaaaagtcttgcacctccttgttaaatatcattcctaaatgttttattcatttttatgtcattgtcaatgaaattgttttcttaatttcctttttggattgttctttgctactgcaaaacttttacgctgaaaactatcaaacattgctgtaagaaattttaaaaaagcaaaataaacaggaagatattccatgttcatagatcaaaatggtgttaaattacccaaagcaatatacagattcaatgaaatccctaccaaaatctcagtggtgttattttaaaaatggaagaacttatattcaaagtcgtatggaattaaaaagacttattgaccaaaaacaatctggtaaaagaaaagcagagttggcgggactcacactttccaattttgaaacatatcctcattccagggcagctttagtccccttttctttggatcattctttgactctatagagattcctcccgttttcttcccatggctgatggtgtgagctttaattttgaaggcttttcccattgttgtatgacttctgctcctggtgtatcttccactggctaggagctcattcagaacaggtattaggacattcttctgtgcattttaaaggtctaagatggcactgtctaatatagtagtccctaggcccatgtgattgccaatcacttgaaatatgtgaggcaggtggatcacgaggtctggagttcgagaacagcctggccaagatggtgaaaccccgtctctactaaaaacacaaaaattagccgggtgcggtggtgggtgcctgtaatcccagttactcgggaggctgaggcaggagaatcacttgaacccaggaggcagaggttgcagtgagccgagatcgctgcactctagcctgggcaacagagcaagactccgtctcaaaaaaaaaaaaaaaaatgctactgcaaattgagatgtgccatgagttaaaatatacgcaggatttgaagacgtactgtgaaaaaaatgctgtaaaatatctcaatgttttatgtggattacatatttaagtgatattatctggggtacattaaattaaaatgcattattaacattaatttcaccccttctcaccttttttaatgtgctgagtgtggatttaaatttcatatgtgggctgggcacagtggctgacacctgtattcctagcaccttgggagtccaaggagagtgaatcacttgagcccaggagtttgagaccagcctaggcaacatggtgaaacctcgtctctacaaaaaaaaagtacactaaaaattaacccggtgtggtggtgtgcacctgtagtcccagctatttgtgggtcggggggagagggagggtccgggaggtcgagggtgcagtgagctgagatcacaccactgcactccagcctgggctatagagcaagaccctgtctaaataaataaataaataaataaataaataaataaataggccgggtgcagtggctcacgcctgtaatcccagcactttgggaggcctaggcaggcagatcatgaggtcaggagatcgagactagcctggccaatacggtgaaaccctgtctctactaaaaaaatacaaaaattagccaggtgtggtagtgtgtgcctgtaatcccagctactcaggaggctgagccaggagaatctcttgaacccaggaggcggaggttgcagtgagccgagatcacgccactgcactccagcctgggtgacagagtgagactacgtctcaaaaataaaaaataaaataaataaatgtgtggcttatatttcttttggcagtgctggtttaaggtgtgtaaatgcagaattgatgaactgaccaagctaggtagaggagatttccctcttttggttccacacatccctgaaagaggagtcccccagccaccactgccagcttctgggaatcctgtggcatttcattcaccggcttttctctcccctcccaggacaccatatctcagaagacggtagagattgcatctcctgcaaatatggacaggactatagcactcactggaatgacctccttttctgcttgcgctgcaccaggtgtgattcaggtacagaacatatggaccccatgcctaaaggtggaatgcggggtgatgacataaaagttgtagctaaaatgggatcaggagacctagattctggtccaccttggtcttcatcataccatgttccatgattttgtctttgagctttttaataaataaaacaggcccggcacagtggctcatgcctgtaatctcaacactttgggaggcatcacttgagcccaggagtttgaaaccatcctgggcaacatgagaaaccccgtctctacaaaaatataaacattagccgggcatggtggcgcgtgcctgtatttccagctacttaggaagctgaggcagaaggatctcttgagcccaggaggccgaggttgcagggagccgagattgtgccactgcattccagcccaggcaacagagcaaaaccctgtctcaataattaattaaaataataataatacagaaattatttgtataatgtatgctacatggtaaggaaatcttttaaactgtcagctgcaagggggtggggccatgagccaggccaagtggacagggctggatctcagcagtggcacaggtctgctttggggccaggctctctcccctgggctctgtgctcctggcaggtgctcggcctcactcacccttcaggttctcaggcctctccctcctccccagcaggctgggccttggggaagtcccccaagggctcctctccttgcagtctctcaggtgatcccttgcacttcccttgctactggccatgcaatctaaacgatgcttgtcccctaaacggtgctttcccctaatctaatgtaataaataatgaactgtggtccttttgtatgactcaacgagtgttagtgacagctgaagggtgggtatcctgaatgagccatgagtgtgctggtgcagaaactggccctcagaactccttggcaaactgagttgagctgagtagcagggtcttggggtggggaggaagggtcaagggacacatcaggaaaacacattcccaaaaccttatgctctgtcgtcaggtgaagtggagctaagtccctgcaccacgaccagaaacacagtgtgtcagtgcgaagaaggcaccttccgggaagaagattctcctgagatgtgccggaagtgccgcacagggtgagacaggagccgggggctcccagtagctccatggaaccccaaaagacccaagtctccttgtacccctgtctctcccctgacagcacccgcaaggggcatccttgaggctgtggctgcccctcctggtccctctgcgtgtcaccacccctgccccctgcagcagcctctttccacccctccccagcacgagtccccttgaccaggctgacttgttcactgaccacagaaggccatgacttggggcccatgataattttaggggcccatgaaatgatttaatttctcttgaaataagaagaatgagtagaatgcagccaggcatatattcatctttataccaattcagcaataaaatgtattttttaatatttttatgcatgcaggggcccataaagacaaaagtgcccatggcccacaaaaggcataataaggccatgggtggagctccttcaagttcccatgaggacctgagcccacccagccggcctcacccctggcccctgatccctcagtaagacctgtcttttccctatttgggttttaggggccaagagtaatttgctcttctctggcccccctagtatttgctgtgattgggggaaatgggcagacagctggggacaagagctcacttttgtggttgactggaagaccggactcatcttgtggccacacgggcttgtgaccttcccctggagtgtgattgctcctaacgcaggcctcccctgcagcccagggaagctcagtgtgtgcccagcacagaaggctcctggaactgcagctctgaccccagagcagggaggccgaggggctgaagtgcgcatgctcagacccttccccagcctcaagaagggagcacagggggacccactgctgacacgaggagactgtccttcccctgacaccttctcagggacactggggagggagggtggctcctctttcatcccacctggccagctttccatcaagagtcccccctctccctctgtgtgtgtacccaggtgtcccagagggatggtcaaggtcggtgattgtacaccctggagtgacatcgaatgtgtccacaaagaatcaggtacaaagcacagtggggaagtcccagctgtggaggagacggtgacctccagcccagggactcctgcctctccctgttctctctcaggcatcatcataggagtcacagttgcagccgtagtcttgattgtggctgtgtttgtttgcaagtctttactgtggaagaaagtccttccttacctgaaaggcatctgctcaggtaggtgctggctgagggcgggggcacagggcactctctgccctgccccctcccaccctattcccacagacagaaacgcctgcccctgccccaagtctaagtgcctccagcctggctctatcctcctcctcgtggtcacccccatccccacatcccgtgcaccccccaggaccctggtctcttcagtccctctcccaggtctgggggtccccatatctcccagccaagtccaggagggcagggccagttcctcccatcttcaggcccagccaggcagggggcagtcggctcctcaactgggtgacaagggtgaggatgagaagtggtcgtgggattttttcagccttggtcagagcagaaccagagattttccaagtgtttgtttttactctagttccccttctcatcccccttcctcagggtgtctctgagttgtaaggccccattctgtccccagccccagggctccttgtccagtgtcccagcccccagcccagccctgcgccccactgtcctctgggaggggggtgcttcatgggcccctcccttcctgctaaggagactgcttcttttttaggtggtggtggggaccctgagcgtgtggacagagtgagttgatttctccaggagctgggggctcaggggttcaggaactgcttcctgggacagcagaacctgggtgggtgggtccccattgtcctcatggctgccctgactctctgaagtggcctgggtgctctgggctgactgtgggggacacatggccattttgagcaccacataggctggtgagccctgctgcagcccaggtgacatcctcaccccacagcctgcaccctagggatggggtgtctgcctgagcacagcactgggggcctggccccagcagcgggtcctggatgtgctgagtctgggctgcctgcggtgacctcactgagagggggtggggatgtcaggtgcagctgcatactgaggaccctgcagcgagccctaggtgtggactcctgagtcggctttttgccttcccaatgtctttttccagagctcacaacgacctggggctgaggacaatgtcctcaatgagatcgtgagtatcttgcagcccacccaggtccctgagcaggaaatggaagtccaggagccagcagagccaacaggtgtcaacatgttgtcccccggggagtcagagcatctgctggtgagtgggggacagatcattttgtttcctggcatgctgctcacctgggatttcgtagacagtgggagagggcagtgccttagctctcctggcccaggggaaatggaacctgaaggagccaggggactgcaggggatggagcagctgcactgaggtggtgaccgtgccagtctgcaggacatctgcttcttactccctgtcctgtccttgctgtgtcccccgagcctggagctccacaggcatagagtgggggtcacagggttcattgatgagtgaataaggctgcacagtctccatcgtatgctcctaacagaagtcagtgagcccttgcttgtaacagcaggagttttaaatttactctgaaattgttattacattgaacatatttcaaagttcgtagggcagcttccaaaaagtaggattccaagtcgatgcacaaagggcttttgtattggacacacgcacacaatcagttcatatcaatccatcagttttgatgtgatattgagtaggcaggaaatctgtatatacatttattgttcattgctcgtaagcactgaaagtccttccctcgaacataagatgagactatccagtttcctgcagtgttttatttttaatgatttgatttttaacatacagcaatataatctaaacagaattgaattttcgattcaatataagctgagaaactccctgaattattctgagtctctgtttccttcttccaagcccatttagcaaccaattcttcctttttcccttgcctttgcccttttgccacctcctttgctacatgtcaaatgtttacttttttctctcttcctcttcactcttttttaaaaaaacaaacaaacaaaaaaaaactagatcttatccttgaaaatgtcaaatgtttatatgggcagagatctcttccacctagactgtttctgtttcttccttgcatctgtaccactttctttttaaataaagagaagagattttaaaaggaaacaaatgaacaatgccaatacttcctccatgcttattaatgactttgaagatttttttttttgagacaggatcttgctctatcacctgggctggagtgcagtggcaccatcttggctcattgcaacccctgcctcctgggctcatgtcatcctctcacctcagcttcctgagtagctggaactataggcatgtgccaccgtgcccagctaagttttgtattttttgtagagacgaggtttggtcatgttgcctaggctggtctcgaactcctgaactcaggcaatccaccctccttggcctcccaaaatgctgggattacaagcatgagccaccatgcctggcctgatcattttttgaaagcaggtcacccatagccacacatccaccagagtatgaaaaaacttgatcataccaagagccttctttactctttcccagccttttggcccttcttatttcaggtaactacagtggataatttcttgtgattctttgctaaactctttatgcatataccatctaggtacataaatgcatatgtatttatgtggtattgacatgaaaaggattatatcatgtacaacaccaaacaaaactgtctaatatgttttaatatcttagacagcaaatatgttttcaaaattatttttacacatcttataatttagaattagataaaatttagaattataagattttctctagtacccctcccgcccacatagtcactagactttacaaatattaatttaaattaatacatggttctaggaatgattgacatcctttcaacattcaattttattatcaaagaagataatatttcaagtcaagtgttctattatgactcaatcgagatttgggagtttatttcagataaatttttcctattcctcatcaaagctgtttctttgcattttgggtcttcttgtaagtccattttctaatttattatgtctgctgctacttttcttttctttctttctgagatgggtctcactcttgtcacccaggctggagtgcagtggtacaatcatggctcactgcagccttgaccttctaaggccaagtaagctcggacttaccggcttctgagtagctcggacgacagttttgtgccactacacccagcttattttattttattttattttatttttagaaacaggatctcgctatgtcgcctaggctggtctcaaactcctgggctcaagcagtcttcacacctcagcctcccagagtgctgggattacaggtgtgagccaccatgcctggcctctgctatgtggtttaacattcatcagggctaggtgcagtggctcacgcctgtaatcccagcactttgggaggccgaggcggatggatcatctgaggtaaggagtttgagactagcctggccaacatggtgaaaccctgtctctactaaaaatataaaaatacgataaaataattagctgggcatggtggtgcacacctgtaatcccagctacttgggaggctgaggcaggagaatctcttgaacccagaggtggaggttgcagtgagccaagatcgcactattgcactccagcctgggagacggagtgagactctgtctcgaaaaaaaaaaaaatcatcaagacatattcacttttgagtattacaaattaaaccttggggttttaaaaatatacactcctaatctaaaatattgactgctgtatcggcctccttccgagagtcttgcccctttgtctcctgtcttgttgccagacctttcagaacaatgttctggaagtgacgtgctgcaggtctcagagctggctggtggtcggggtcagtactggactgtaggactcctggctctgaccaggacattccccactatgtgttacaggaaccggcagaagctgaaaggtctcagaggaggaggctgctggttccagcaaatgaaggtgatcccactgagagtaagtgttttgctcctggagatgcagcaggaatggagggaatagggacagggtcctaactgctgtccccagaggtcagagggctcttccagagtattccatgctggaagccgtgggtcctgtgctatagaccatctggaccctaaactgtcttctcccatctcttctccccactctacctcatcctctctgcaccctatcattgaccctaatgactctgtccgtcccctcatcctctctcctcctttgttcagggcctgatgtagcccccgcctgcccctgaggacctcctgaggggctggcctgtcctgcacagcaccactaaccccagtgggctaaggagctcttgacctgtgcctcagcccaatttgcagagctgttgtgtaaactacatacgaatgccaaagacttaatgcaaaaaagagtggaaaatatttcactcataatttttgtatattgattgtatattaaattatattttaaatatattcagtaccatacattaaaatgaatgtcacttgtttctgatgttctttaaaataaggctgttggaaaacatagcctcgtgttcctgaccctgtctatctctgaggacggcgaggtgcatcatgttgcacacacgtctcatttaatccctcatcgtcccgagatctgggcagcattgctcggtctttgggttcacttcttgctcagagtctgtttgcctccacctagctctgccccagccccaggaagtgaggccgagctgggtgaaaacagaggtcccctgtcccaggccctgtgctttccacagatgcagaagtggccgccctgggacctgctcccatgacaagcgcagcccaggcagcctcctccctcctctaagctcccgctgcagccactgtctctccctccctcggactctcacgcactttactttctgcctctgtaacgtccatccatactcccctggtgggttctcagccctgtatgagggctgattctctgacgactttgactccccgcagtgccttgcgtgtgggggaggccaggcagtgtgggcgcgctctctgtggatgggaagcgggtgggcactggagcggcaggtttgcccgcacacggggctctccaggttccccgccttgggttctgggcctgatgtggaatcctctgccctttctgagtcccaactcacctggctgtctctgtggctttctccaccagctctgagacagtgcttcgatgactttgcagacttggtgccctttgactcctgggagccgctcatgaggaagttgggcctcatggacaatgagataaaggtggctaaagctgaggcagcgggccacagggacaccttgtacacgatgctgataaagtgggtcaacaaaaccgggcgagatgcctctgtccacaccctgctggatgccttggagacgctgggagagagacttgccaagcagaagattgaggaccacttgttgagctctggaaagttcatgtatctagaaggtaatgcagactctgccatgtcctaagtgtgattctcttcaggaagtcagaccttccctggtttaccttttttctggaaaaagcccaactggactccagtcagtaggaaagtgccacaattgtcacatgaccggtactggaagaaactctcccatccaacatcacccagtggatggaacatcctgtaacttttcactgcacttggcattatttttataagctgaatgtgataataaggacactatggaaatgtctggatcattccgtttgtgcgtactttgagatttggtttgggatgtcattgttttcacagcacttttttatcctaatgtaaatgctttatttatttatttgggctacattgtaagatccatctacacagtcgttgtccgacttcacttgatactatatgatatgaaccttttttgggtggggggtgcggggcagttcactctgtctcccaggctggagtgcaatggtgcaatcttggctcactatagccttgacctctcaggctcaagcgattctcccacctcagccatccaaatagctgggaccacaggtgtgcaccaccacgcccggctaattttttgtattttgtctagatataggggctctctatgttgctcagggtggtctcgaattcctggactcaagcagtctgcccacctcagactcccaaagcggtggaattagaggcgtgagcccccatgcttggccttacctttctacttttataattctgtatgttattattttatgaacatgaagaaactttagtaaatgtacttgtttacatagttatgtgaatagattagataaacataaaaggaggagacatacaatgggggaagaagaagaagtcccctgtaagatgtcactgtctgggttccagccctccctcagatgtactttggcttcaatgattggcaacttctacaggggccagtcttttgaactggacaaccttacaagtatatgagtattatttataggtagttgtttacatatgagtcgggaccaaagagaactggatccacgtgaagtcctgtgtgtggctggtccctacctgggcagtctcatttgcacccatagcccccatctatggacaggctgggacagaggcagatgggttagatcacacataacaatagggtctatgtcatatcccaagtgaacttgagccctgtttgggctcaggagatagaagacaaaatctgtctcccacgtctgccatggcatcaagggggaagagtagatggtgcttgagaatggtgtgaaatggttgccatctcaggagtagatggcccggctcacttctggttatctgtcaccctgagcccatgagctgccttttagggtacagattgcctacttgaggaccttggccgctctgtaagcatctgactcatctcagaaatgtcaattcttaaacactgtggcaacaggacctagaatggctgacgcattaaggttttcttcttgtgtcctgttctattattgttttaagacctcagtaaccatttcagcctctttccagcaaacccttctccatagtatttcagtcatggaaggatcatttatgcaggtagtcattccaggagtttttggtcttttctgtctcaaggcattgtgtgttttgttccgggactggtttgggtgggacaaagttagaattgcctgaagatcacacattcagactgttgtgtctgtggagttttaggagtggggggtgacctttctggtctttgcacttccatcctctcccacttccatctggcatcccacgcgttgtcccctgcacttctggaaggcacagggtgctgctgcctcctggtctttgcctttgctgggccttctgtgcaggacgctcagcctcagggctcagaaggtgccagtccggtcccaggtcccttgtcccttccacagaggccttcctagaagatgcatctagagtgtcagccttatcagtgtttaagatttttcttttatttttaatttttttgagacagaatctcactctctcgcccaggctggagtgcaacggtacgatcttggctcagtgcaacctccgcctcctgggttcaagcgattctcgtgcctcagcctccggagtagctgggattgcaggcacccgccaccacgcctggctaatttttgtatttttagtagagacggggtttcaccatgttggtcaggctggtctcgaactcctgacctcaggtgatccaccttggcctccgaaagtgctgggattacaggcgtgagccaccagccaggccaagctattcttttaaagtaagcttcctgacgacatgaaataattgggggttttgttgtttagttacattaggctttgctatatccccaggccaaatagcatgtgacacaggacagccatagtatagtgtgtcactcgtggttggtgtcctttcatgcttctgccctgtcaaaggtccctatttgaaatgtgttataatacaaacaaggaagcacattgtgtacaaaatacttatgtatttatgaatccatgaccaaattaaatatgaaaccttatataaaaagaggtgtggtttttgtctcccgccccccaacctcccctcctcctgtgaatcagctctgagtgacaggaaaccagggctgtgctcctgctgggactccttccttcctccctcccctctgttttcaggcttggcctcctgggggtgtttcctgaatccgactccccagagtttaaagagctaggttcctggggactgggattcatacctccttcccctctctctcctgcctgctcctccctctggggacagggacaccaatgttggcctggctcacccacagcctcccaggagagttctctgggctgccgggttgcatctggttccgacagctctcggggaatgggcggtgggtccctgaagttggggggccggccctgtttctcagggaatcccgtggtcactctcctatggcttcctacagccctgggtcgaccttcactttctctgccccggccttccctgcatccccaccagggtacccaggttgctcagcgcttcaggcacctaggagacctatttcccgttccccttgccctggaggacccgctctccctttcgtccacagcttccgggaggcccaggtgtgcccccacgctgtccatcttccctagaagtggaggtgctccgggttcccccttcgtccccccagccctgcccatgggcttctgggcctcacttggagccctgggctgcgctgagctgcagggaggccgagcagcctgtagagggcagcatacgcgtggctttccagccagccgccctggaggccgtggaggggaggcagccacagtcctggaggggcctgggcctggacaacatggccgcccccagggttagagccgcttgtcctccagccgcctggtctctcttgatgaggatttaacctctggtcattaggtcctgcctgctacctttgtttcaggttagctcaatcccaggcctaaccagcgttttcctggagcccaccccagggccaggccctctcagctagaacatctctctcaggtaaggcgactcctgagctctgagcccacagccccactgcctcctggctctgcccctcctccgtgggactccatcttttacacctaaaaagagtgtgggtggtgaaatctgagtcggggttagaaaacggaaaggggcaattgtggcccagctgctgccccatgggggctgggagctagtttcaatcccccacattcctccagccccgccctcctcctctctagaccaactctgcttttcctcctgctccattctccctcttctccttccccttatcccaccccagcagtaataaggctgtgtcctgtggcctttcactacaggtcagtgcccctttccctgacttttggcccctattgcagccccgcaaaaacacccaccataagcactctctgagggtaaggaagggagcctgcagtctccagatgggcaaaagcaagagtctggtgccatttaagccccgagaccaaacccctctttgccgccagcccgggcccctcaatcaccagccctctagaggccaggcccctgtgttgccctcggagccagctggcagggtcagggcctccgcagtcagagaagtgccgagtcctttcctgaaaggcattggagtcgattctgcaacctaaatcttcacctcctcatcatgggggcctctgtttatagaaatgtgagctaggcaggggctttttctgattttcattctttggagggatagaggacagagtgtttgttgatttttcgtttcggtttcagtttggttgtcattggtttttgttttttgctaattttgccccaccctataaaaagcagtgccacccagaggcaggggagggccctgaggagcacggggtcgccgtgcactcattcctacttccttctccacctgtcccagctgcttcctttggttaccatctccaaatctgagggtaaaggagggggtgagggagaagtttcttgttgcaccaagaggcactgcttccaggcctggagct

SEQ ID NO: 27 - DNA, 200498 bp, homo sapiens
tgacctcaagtgatccacccaccttggcttcccaaagtgatgggtgggattacaggcatgagccactgcacctagccaagctcaatgaattttaaaatataaatgtgtgtgtacgtgtgtgtgtgtgtgtgtgtgtgtgtgtatatatatatatatatatatatatgtttaaaaccacataactaccaccaaatcaagttatagaacatttacatctccctaggacatttcttcctatcttgactttgatcaacatatgttgttgttattattattattattattattattattattattattattcagagacagggtctacctctgttgcccaggctggagtgcagtgttgcaatcgtacacaattcaccgcagtctggaactctggggctcaagcaattctcctatctcagtttcctgagtagctaggaccacaggtgtgtgccaatatgcccagctaatctttaaaattgttttgttgaggcaggcatggtggctcacgcctgtaaccccagcactttgggaggccgaggcaggtggatcacaaggtcaggagtttgagaccagcctggccaacatggtgaaacgccgtctctactaaagatacaaaaaaattagccaggcaccgtggcacgcacctgtaatcccagctacttgggaaactggggcaggagaatcacttgaacccggaaggcagaggttgcagtgagctgagatcatgcctccgcactccaacctgggccaaagggagagagtctgtctcaaaaaataaaaaaaaaaaagaaatttgttttgtagaaatgaggtctcactatgttgcccaggctggtctcaaacttctggcctgatgagcaatccgcctgcctgggcctcccagattgctggtattacagacatgagccacagtgcctggctcttgaataatgtatattagttttgcctattgttgaacatcgtgtaaatgagatcatggcaaatatgctcttttgtgtctgccttgttttgctccttgttgtgttttgtgggattcatacatattgttgctattatgaacattttttgtagatgtgttttggtggatgtaagctcacctttcttttggaggcgagtggaatttctgtgtcactatgtaattgtatgtttcactttagcacgaattattagttttctttcttttttggagatggagtctcactctgtcacctaggctggagtgaagtggtgcgatcttggctcagagcaacctgtgcctcctgggttcaagtgagtgttgtgcctcagctccccaagtagctgagactataggcatgtgccacaacgcccagctaattttattttattttattttacttttgagacagagtctcactctgtcgcccaggctggagcgcggtggcgcgatcttagctcactgcaacctgcgcctcccaggttcaagcagttctcctgccttagcctcccgagtagctcggattacaggcatgtgccaccatgcctggctaatttttttgtattgttaatagagatggggtttcctcatgtcagccaggctggtcttgaactcctgagctcaggcaatccacccaccttggcccacctttttgtattttttgtagagatggggtttcaccatgttgctcaggctggtctcaatctcctgagctcaagagatccacctgcctcggccacccaaagtgctgggattacaggcatgagccactgcacccagccaaattgttagttttccaaagtagttaagccaatttatatacctcccaacagagcgtgccttttccagttaatccacgtctttgtctgcactcgtaattttcagtctttgtttccagtcactctggtgggtgtatgatggtatttcactggggttttatttgcatttccctgatgactaatgaagttgagcatgttttcatgtgcttgctcaataaatatttgttgaaaggatgaataaagagtgaatgaataaaacatggaaagaaatccaactctgtcttgtgccctgcctaaaacccaccagtggttcccactgcccctcctttggccgacgggtacctgcctgccctggctccttctgaccccacctgctccggatggatttcttttgcttcttctctgggttcctgccatccaggctgtcttcagtttcctccaaggaccctccctgcttcataactttgctataaactgttttcttctgcccagaacacaacccaggcccaaggaacccagacgcgttccttgtatctcagtttgaaagcctcttcctccaggaagccttctctgacttccaccccccagcaagggtggtataaattgctaacttaggcccacttttgcccactttttttgtttgtgtttttgagatggagtcacactttgtcgtccaggctggagtgcagtggggccatctcagctcactgcaacctccatctcctgggttcaagtgattctcctgccttagcttcctgaatagctgggattacaggcacccaccaccatgtccagctaatttttgtatttttacatttatttatttatttatttgagatagagtattgctttgtcgcccaggctggagtgcagtggcatgatcttggcttactgcaacctccgcctcccaggttcaagtgattctcctgcctcagcctcccgagtagctgagcctgcaggtgcctgccaccacacccagctaatttttgtatttttagtagagatggggttttaccatcggtcagactggtctcgaactcctgaccttaagtgatctgcctgccttggcctcccaaagtgctgggattacaggcgtgagccaccatgcccggccaccactttttttttctagctgtgaccatagttgtacatatctccccttccctggcttttttttttgttttttttttcctgagacaggatctcgctgtgttacccaggctgcagtgcagcggtgcaatcatagctcactgtagccttgaactcctgggccaaatgagcctcccacctcggcctcccaaagcactgagattacatgcgtgagtcactacttctggcctgtaaataccctttcaaaaatataatatttgattaacatctgccatcttaccataagaaacacttaaaaaaatcccaatccaaaaaaattccaatcctttaagctatataagagtagcaattttatcttgttcctagcaagacatctggcatatagtaaatgctcaataaatatttgttgacagtataaaggtcaagcaacagcataactggcattattacatgaaagtaattatcccttagaaactcattcacccttgggggacccgggccaataaaaaaatcacagaaaacaatcctatctaccttcctccttcctccttccctcgctaggtcctttgattggggggaggtctcaaatgcacacactgtttctgttttatttggtgcagctgttgtgtgcatgtgttatggaaacccacatcaggcaggagattaaggaggagaggagaaaagaaaggcatcgctggtatcacagtgaaatttacactctgcggcctcgccctagctcctctgtctctacctgtctgcctatgaaacagttcaaaactaatatggcgcaatggatggtattatagacttcccacctccctggccagacttcttgggttcaaagtttggcttaatcacttaccatctaaataatccctgacaatgtactctgtctttctgggccttagtggcctcatctgcaaaatggggataatactacttcttacctcatggggttgtgaggattgcacaagttaatttgtgtaaattgctaagaacacagccttaggaagccttgtcactgtgaatgcatattaattttttttattattattttttgagacagagtcttgctctgttgcccaggctggagtgcagtggtgtgatctaagctcatttcaacctccgcctcccaggttcaagtgattctcctgtttcagcttctcaagtagctgggactacaggtgcccgccaccatgcccggctaatttttgtgtttttagtagagacagggttttgctatgttggctaggctggtcttgaactcctgaccttatgtgatcggcccgcctcggcttcccaaagtgcttgattacaagcacgagccaccatgcctggcctacgattatcatgtctccaggcttcagtttccttacctctgaggtgaggatcaataacctggttatttctaagtgatgcttaaagaggttgagaagaagcaaaggcgctctgcacacaggtgaggtcaacagctgttagtgatggagactggcgccgtctgggtcatcagtgctccggaatcaggctgctcacgggtttgaatctcacttccactttcactccttattaactgtgtgacctcgggcaagtcacttcgcctttctgaacctcagtttccccatctgtaaaaggtaggtgaataacagtattcacctccttctgtgtgactcagctttggagtcagcggaccgggttcaaatcccagccctgcaagtgattagccaggtgaccctgggcagagggaatcactcaacctctctgcacctgggtttcttccttcatgaacgtggagactttacaggatgaaatgagggcacagttaaggcgcccggtacactccaggcaggtagggggctccgttcacgttattttcccctggtgacggatactgtccttaaacagcatttgaaaagtggtcgcagggtgtgtggccccaaagatcccaggcgcttccggaaggcgagccaacgctccccaggcccgtccgcgagcgggtgggcctaagccttggaggatctggggtgggggtggcgcggggtccaggcccggggcgccgagaggtggctggtccggctgcccacgccgagacgcgcgaggtgagcgggcgccggggcggggcggggtggggcggggccgccgcatccccgtgacgcgcgggccaaccaggcggcgttgcggccccggccccggctccctgcgccgccgccgccgccgccgccagcgctagcgccagcagccgggcccgatcacccgccgcccggtgcccgccgccgcccgcgccagcaaccgggcccgatcacccgccgcccggtgcccgccgccgcccgcgccaccggcatggcgctccggggcttctgcagcgccgatggctccgacccgctctgggtacgtgccgggggccgcgtgaggccggcgggacggagggaggccggcggggagggaaagcaccgggcccgcagccgcccggggcaccccgctccccgctctgctgccggcctcgggggcccgggaccctcacgtcgcccgcggcccagcccctttcgggggtgcaaggcatgggggaaacttgggtgactcagttcctgcggagcagagcgtggggggccgcgtgcccagccctggggttttggagggtcgggtcgggtcagagccgccgtgaggaggccttcctgttttggggttcccgtctgtaaaaacaaccttccagggaaggggacgctagagatggggggcgggaagaggggtgtctctctgcttctgttttcccatcttttttgtggttagggtccccccttttcacgaaaaatactccgtgaccaacggggtgagctggggaggggcttagattgtagaaagggactttcattgtctccccaaagttgtcgtacaagccacattactcttctgtggttacctagctttgttttttttgttctttctacttagatactgcgggggaagtttgggggaaccagggaagaagggggatgtccacccttgatgtgccctacctgaccctcggctcggggcagacttggggtgcagctgaggacgcccaggaccctggtagctgtggtcctgccctcccttccctgcaacacgtggagctcctctctggggatgccccttagatttaaccccggcaagttttcttctgtaacgtggcctgcggagcctgactgggtgtctggagtccacttgctgtggtttaagccccagtcttttgggcttcagcttctccgtaatgcgatttgcctctttgttccaggaaggcaggcacttctgtctcgtgctgtcttgattgttggtgaacgcagtaggcaaatctggacacgactgtttctctctcctcttttgtttaggaatcaggagaaacagccttggttcttaggagctggtgatcagcttccaaaaatactttcttgtcctgttttgccggcctttcctcgagggttgcatttggagtgttgaaaagtcatcctccagggccccattggagggtttggttttgtttgtttgttttttttagtagggtatcattgtgtttaataacctaccacactttgatatatctcccattttaagccagtggggttggagagtaaccccaggggtggaaatagaacacagactttgccttgagggtctgggggtgattggagcctctttgcagatggactttctttagcaggggaaaacctgtggcttccttgttgccaggtgtagtaacagcaagattattttttgcaaagattcacatggtgatctgggtttgtgttgctgtgaattccagaatattctcttgtttattttcttctgaattgaggagggggcaaaacagggtgaacatccatgaggttttgtatcaggacgtattttattgatggcaattggtagttgatggctaatgagtatgtttggggtgcgctttgtttatcttaagaaactcattcacgaagtccagttgtaatattttttaaaatttttattttcttttttctttttattttttccttcgttaaggactttctgccacagaaattgccaggtggttgggttttgcttgggggtaattgtagctgatctctgcctctggtaggtaccccatccccgtgtttgaccttgcgtatttctgctgtctggattccaagacttgttggaggtgccttggaaccagaatttgagaggaggcaactggggcctgagtgggaaaattgaaatataattaactgaaagctagaaagtaggtagttgttgcttttttcttttcttttttttttctttttcttttttgagacagagtcttgctctgtcacccaggctggagtgcagtggcacgatctcagcttactgcaatctctgcctccccggctcaagtggtcctcctaactcagcctcccaagtacctgggactataggcgtgtgccaccacgcccagctaatttttgtattttttatagagacagattcgcactatattgcccaggctggtctcctactcctgggctcaagcgatcctcctgccttggcctccaaaagtgttgagattacaggcatgggcctctgtgcccggctgtttttgtgtttttcaaggtagcgtgtccgaggccaggagcgactggcctcccaggcagtcagataactgtgtgaccttgagcaagccactttccctctgtgtgcctcactttcctcatctctaaaattggacaggagccaaaaatgtggcagccttcttgggttgttgcgaagggtcaatgagttaatcttgtaagtggctcagcttgtgccctgcacggagataaacaatggttagtattaaatattattttttccaaagatgaagttgtgtgttttaagctccttgttcttcctttggattccccttttcttcagctggtggagatgggattgggctgtgaaaaggcagtgaggcacccgtgcctggctcctgttgtgaccaaggtcatgtgcttagaagtcaaggtcagtgggcctcgggtgactctgtcagagctttgtttctgggctactgtctgcctctgagccgcaggaaatgtccagaaaacccagaagatggaaatggcccatgataagtgttctgttgacctttactcagacagatgctctgggaagagaaaaggagaactttgctatcaaaacggaaaatagggcctgaggacaggtcacagcagcccttggctttcttttctcatgggggtgggactggtaggaggcgctgctttgtggttgatattggcatgatggttggaaaaatgggcctgggactttttgtgagttcattaaaaaaaaaaaaaaaaaaaaaaaaaaaagcaggccgggtgcagtggctcacgcctgtaatcccagcactttgggaggctgaggcaggcggattgcttgaggtcaggagttcgagaccagcctaggcaacatggattgacccccgtctctactaataataccaaaaaaaaaaaaaaagcctggcatggtggtgtggcacctgtggtcccggctactagggaggctgaggcactagaatcacttgaaggctgtgggggtggaggttgcaatgagctgagatcacggtcactgcactccagtctgggccacagactgagaccctgtctcaaaaaaaagagggccgggtgtagtagatcatgcctgtaatcccagcactttgggaggccaaggcaggcggatcacctgaggtcaggggttcaagaccagcctgaccaacatggcaaaaccccatccctactaaaaatacaaaaattagctgggcctggtgattcacgcctgtaattccagctacttgggaggctgaggcaggagaattgcttgaacctgggaagaggttgcagtgagctgagatcacatcactgcactccaacctgggcgacagagagactgtctcaaaagaaaaaaaaaattgtgcttcaggccctgtgtagaaaaattggaaattatggaaaagcagaggaaacaacttggtattaagcagtatagtgtggtggctcagagcaaattcgcctctgctgctgaggcaggttacgtcatctctccgtgcctcagtttccctatgtgggataacgtagtacctagtgaatagcggtgacttgaggaataagtgagttaatccttagcaaggacttaaaatgttgctgcttggcacacagcgctcagtaaagatcagtggtcgttgccacctggaattctccagttaatttttgctgttgcaccaactgccactggagaagaccagaaggaagctgcaggtgtgtgtcaccgtcgatggagtgagctggtcccagggttgatgtgcacctctgagatgctctgtggcatccaccaactcagtaaccccctgaatatctgacttagccgccaaggaagaatatcttagaagctattaggaattcctcttggggctaggtctgggccttggagtcagtctgatccctggtttaattcttccccttggctcaacagcagtgtacgacgagccaatttttcccctcctccaagtgtggctttggttttcaaatccatcccttagccttctcctacttcctctgttttcccctccccaccctttttttttttttttttttgagatggtgtcttgctgtgtcgcccaggctagggtgcagtggtgtgatctcggttcactacaacctctgcctgctgcgttcacatgattcccctgcctcaggctcccgagtagctgggattacaggcgcacagccaccatgcctggctaagttttgtatttttacaaaactttacaaaacccccatagagacggggtttcatcatgttggccaggctggtcttgaactcctgacctcaagtggtcaacctgcctcagcctcccaaagtgttggggattgcaagcgtgagccaccgcgctcagcctgttttccccctttttggctgcccctccttccagacccttcctctctcccttccttatggagtgttagagtggaaagggatgtcagatcttggggggccctcctctccacccaccccatttcgtggatgtggacactgaggtccaggatggtgacatgacagggtgcaaggtggcaaggtgaatggctttgggaggagatgagggtgacccgggagaggcctgggcaggagtggactcaggggttcctggtccaaatgggttcgtgattcaggccaatcaggagcggattcagggttccttggccaaatggagccactgcagccacaggggccctgcagaaggcagctgcagccggtccctttggccaagactctcctgaagggtcgtgttctctttctccgaggacaagttccatttgtgatagcctggagggggtgcctcgcctttgggacctggtggtagatgggggggaagaaaaccttttctgtttgtggacacaacttttaggaactgatctctctatgtgggtgtctcccactgaccatgttcctaaagaacgtgagcttcctcttcccatgtcagtctccagctttgacttctctttttctcctcccattcctatcacatctgtcagcaaatcgtgttgcccgttgcctcaaacgggctgcttttcatggcttccccgacttccactctggctcgagtcatcgttggccagtttctggatttgaacagtcacctcagtccaggcgccgtggctcatgcctgtaatcctggcacttcgggaggccaaggcagacggatcatttgaggccaggagtttgagaccagtctgggcagaatggtgaaaacctgtctcaactaaaaatacaaaaattagccgagcctggtggtgggcgcctgtaatcccagctacttgggaggctgaggcaggagaatcgcttgagcccagtggggttggaggttgcagtgagccgagagttcgccactgcgctccagcctgggtgacagtgagactctgtctcaaaaaaaaagaaaacagccacctgttcgctgctgtgcctactctgcccttgacccctacagtctagtcttggcccagctgtccctcttctactaaaaccctgcagtagttccttgagggtacaagccaaagggcttacagtggcctcgaaggctgggcagcatctgtccccttggcctccctgacctcttctctggctgctttctgtctcactctcctccagccacacttgtggccaggcctgtccctgcctcagggcctttgcacttgctgtttctcctacctactatgtccctcaccttcaaactttgttcaggtgtcacctcaggcatcccgttctttccctccactagcaaatctctgtcccccatctacacccccagtagcacttactgccttctaatacacgtaatattttgcttaagtattgtgcctactctgtaaactcctaccaaaagatcggctccataggggcagggattttggcctgtgtttgtttacggctgtaatcccagcacctagaactgtgcctggggcttagtaaataacagttgaccttggaacaattcaggggttaggagtgctgatgccccatgtagttgaaaatttaggatgcagcgcggtggcttacacctgtaatctcagcactttgggaggccgaggcaggtggattacctgaggtcaggagttccagactagtctggccaacatggtgaaagcccatctctacaaaaattagccaggtgtggtggctcatgcctgtaatctcagcactttgggaggccaaggcaggcagatcacttgaggtcaggagtttgagaccagcctggccaacatggtaaaaccctgtctctacaaaaattagctgggtgtggtggcgggtgcctgtaatcccagctacttgagaagctgaggcatgagcattgcttgaacctggtaggcggacactgcagtgagccgagatcgcgccattgcactccagcttgggtgacagagtaagactctgtctaaaaaaaaaaaaacacaataaaggaaagaaaattcaggtctaactttcaactccctaaaagtttaactactaacagcttactgttgactggaagccttaccgagaacataagcagttgataacactaattctgttgttgttggttgttttttgatagagatggggagcttgctgtgttgccgaggctggtctcaaactcctggcctcaagctattcacctgcctcggcctcctaaagtgctgggattataggcgtgagccactgcacttggcctaactcataccttgtatatatattatatactgtatttttacagtgaagcaaggtagagaaaagaaaatgttaagattaattcataagagagatttttactatttattaagtggaagtggatcatcataaaggtcttcatcttcattgtcttcacgttgaggaggctaaggaggaggaggaaggggaggggttggtcttgctatctcagggatggcagaggcagaagcataatctgagtataagtggacccgtgcagtttaaatgtgtgttgttcaagggtcagctgtttgttgaataaatgaatgacatgaagtattacagtggcttttgggcggtgtcgaaacttctttgtaaggattttaaggatgaaataatcacttaactgtctggaatgaacactcagataaactgagtcctccagctttctcatcagatggcttgtttttttattttatttttttgagacagggtcttgctctgtcacccaggctggagtgcagtggcgcgacctcagctcactgcagcctcaacctcctgagctcaagcaattctcccacttcagctccccaggtagctgggactacaggcacacaccaccatgcccagctaattttttttttttttttttttgtagagatagggttttgccatgttgctcaggttggtggtgaactcctgaactcaggcgatctgcctgccttggcctcccaaagtgctgggattataggtgtgagccaccgtgcttggcagaacagcttctatttcatcttggaaaggtcagaacagggttttgtccacccctcttttcccaggactcagtgtctcacacacagtgggggctcaatcaacattagaatttgagtgtttgaggtatgagttccaagctaggggttagatatagctcaccactgtgctggtttggcttgattttaattataggaatgactgtgatttccaattttatttatttatttatttgagacggagtcttgctctgttgccaggctggagtgcagtggcacgatcttggctcactgcaacctctgcctcctgggttcaagcaattctgcctcagcctccccagtagctgggactacaggggcacgccaccacatccagctaatttttgtgtttttgatagaaacggggtttccagtatgttggccagcatggcctcgatctcttgacctcgtgatccgcccgcctcggcctcctaaagtgctgggattacaggcatgagccactgtggcccgccctacaatgtttattcattggcagatttcacagaaacatctggatttctggcttcccttgaaaaatcagaagttctgctagccccaggcccacatttatacatggtagcggtccgctgaggctgtccgtttctgagttgctccagtttgccgcagtccccacccctccctgttgttgctttaattttaaggccaaatgtttgttgcctttgttttattttatattatttttttgagacgaagtctcgctctgtcacccaggctggagtgcagtagtggaatctcggctcactgcaacctctgcctcccgggttccagtgattctgctgcctcagcttcccgagtagctgggattacaggcccgcaccaccacactcggcttatttttgtatttttagtagagatggggtttctccatattggccaggctggtcttgaattcctgaactcaagtggatcacttgagttcctcagcctcccaaagtgctgggattacaggcatgagccaccgtgcctggcctgttgcctttttaaaattgtgcttcctcacacctggtctgcttcttgcatggatggaacccactttggcacctgttggtatctgagttggcatctcctgctttgcaggccaaccttgaagttagcatctgattggtatgttggcttcagattttcatggcgaagtaaggcctagctttgatgatcagctcttagtgtggtcagtacaactctagctcgtgaaaacttgcccaaacattttgccaaaattaattaatggccagacatcctgaggcaagcttccccccgcttagcaagaaaactgggatagggcagcatccctgtgggtggagtggtgctggggacctgcacttacctcttagaggctgaatggttgaacggggcctttgaggaagctgtattttgcgggtggggacatggagcacagttgctcagtgtcggccccgttgacatgtaggccacatcattctttgtggcctggttgctgttctgtgcagcgtagtcttagccccaaacctggcctctaccccctagtagatgctggtagcacctcctcttgttgtgacaaccgaaaatgcctctagatgtttccatatgttccctggggtgtgaaatcacacagccactggtgtggaggaatatgggggagaaacatggagcaagaccttcctcctcatcctgcatttccctaggaggttgtgggctgtcgaaattctagtgtaattggcttactggggttgccttggagaagcttaatgagacgttaaggaggttaaactccaattagctagagaagaaacttgcggcagtttcttttttactgagggctgtgtctttttacctttttccattttcccagttggagttgtgacagttcattctcccctgggaaaacaaaaatggctttctttttctttttctttcttttttcttttgagacagggtctccctctgtcacccaggctggagtgcagtggcacaatcatagctcactgcagcctcgacctcctgggctgaagctatcttcccaccttagcctcccaggtagctgggaccagaggtgcacaccaccatacccggctaatttttgtattttttgtagagtcagggtctcaccatgttgcccaggcttgtctcaaactcctgggctcaagcgatcctcctgcctcggcctcccaaagtgctgggattacaggcgtgagccaccatgcccagccgaaaatggctttcttgagagatcagctttgaagctctactccttcattttaaagtgccccaggagaagtggacgattacaaagttgagattccacttaagtgtccccttagtttaactgtgggattcatctcctggggaggttgccaggttctggaaagtgggtgttaatgaccagggagggtgcccctaggctagcatcctgtaaccctcaggaattgagatttttatggaggttttctcttcctctctgtgagttttctctctgagaaacctgtctagggagggaggctctaggctagcatcctgtaaccctcaagtagtaattgagatttttatggagcttttatcttcctctctgtgagttttctctctgaggaacctcagtgtaccttttactggcctcctaggtaatacttgtttggagaatatgtgtgatgtctaagtcttcccagtacaagaaatttgtgtggtgtttgactgattgatggatggagtcttgttctgtcgccctagctgattgtaccactgcactgcagtctcgacctcccaggccaagtgaccctcccaactcaccctcccaagtagctgggactacaggcatgcaccagcacacccggctaatttttgtatttttttttgtagagatggggtttcactatgttgcccagtttggtcttgaactcttgagctcaagcagtctcccagagtgctgggattacaggtgtgagccaccacgcccagcctcgtgtggtctttgatacccctgggttcattgtattgttcttcccacactgcttttcattcattcatttattcagtcattattaattgagcagctactatgtgctgctgctgctctaggcactgaggatacaacagtgaacaggacagaccaggcccatgttctcatggggtttacactgagggtgacggaaatgatttcagatgctggcaagtgctgcaaagacttgaaccgggaaaaactgggtgaggtgcaaactactacggagggatgtccacagaaggcctttcggaggcggtgaggtttgaccccagagctcagtggcaaagctggccatgcaaggatgtgggggaagggagtcccagagtgggaagagaatgtgcataggccttgaggaagatcatggtgtggttaaagtattgaggagtttaactcaaaggaactgcagagcccatctcataaaaatctagcctggagcattcggcaaaatgcataaagcactaacacaatggcttgtggtcctggaatttccagggaaggcgcttaccagctcagcaaggaagtagaacaatgcatggtccctggcagaagcaagaaccttctgatctgtttatgtttgaatgaaacgcaggttttttttttttttttttttttttaaaatagatgggggtcttgctatgctgctcaggctggtctcgaactcctgggctcaagcaatccacccaccttggcccttccatgtgctgggattacaggcatgaggcactacgccctgctgaatctcaggtcttaaaaattcagtttattttgttttatgagtctcttctctttctcagaaccttaactgaaacgtttgtgatcaagaccaacttgggtttccccactccccagttgcctttgattctccgccaaaggcttgttcgtaagatgatgaggtacttttttcctgtggttaagaggactttctataggttgctagaaaactcttgttttaaaacaagatgttgttgaattgatctggctgattgcaggaggaagatcttgtactgcaactttgttgatgatgctaatactttaaggtgaatattctagaagaatataaagggaaaaataaaagttttagtatgttcccaccctgccctttgttcccagaagtagccgttattgatgatggttgttgatgatagtttcttgggtgtttttcgagaaaagtttcaagtatatgcaaatgtatgtgcaagaacgtgttcgtttgtgtgtatatgtttacatattcattttttccctccctagttgggtattttaaatactgttttgtctcttgttctcttcacttaaccagtgttgattttcttgccattttaagcccatgcaaattgaaagtaaaagccaatcaaatcaacttttttttttttttttttttaaacaagccacgcatttgcctgttaaatggctgagccatgtattcacccattcccctcttggtgtctatcaaggtcattcccagttcctggtttcttgctgtgataagcagtgctgcactgaaggcacatgtatgcaaatatatgtaaatgattcagcagaataaattttcccacaggaaattgctaggttgacagtatgtgcattttgaaatttgatagttaattgtcaggttactgcagcagtttatactcccactaatgggcccaccagcacttattaagcacctgttgttttcctgccatatcagaaaaattgagcaagctgggaagtgatcaggcccatgttgcttggctgtgtgtgagagggctttgcccagttaagttaaaccttactttccagaggtcaggagatcaaagcagaagtgtgctttggttttgttcagttttttaaaagatgtgtttaaattttaaacatctttggacttattttaaaaattgcttttaaatcaataatttaacaatgtgtaaaaacattactgatagtctcaccatgctaatgtcactctgatttttacacctaaactaatttaattgcagagttttctgatcacaagtgacatgtgttccatatgacagaacaaacaatacaaagatatttaaataaagcctgaacatggtactgatattagtttgttcatgctgctatgaaaaaatacctgagactgcgtagtttataaaggaaagaggtttaattgactcacagttctgcatggctggggaggcctcaggaaacttaaaatgatggtggaaaggaaagcaaacatgtccttcttcacatggtggcaggagacagaagtgcagagtaaagaggagaaaagccggtataaaaccatcagatcttctgaggactcactatcaggagaacagcatgggggaaccgctcccatgatctaatcacctccagtgaggtccctccaccaacacgtggggattacaattaagattacaattcaagatgagatttgtgcggggacacagagccgtgccatatcattctgcccctggcccctcccaaatctcatctttctcatatttcaaaacacaattatgccttcccaacagttccccaaagtcttaactcatttcagcattaactcaaaagtctatgtccaaaatctcatctgagacaaaatctagtctctttcacctatcagcctgtaaaatcaaaagaagttagttagttcctagatacaatgggggtacaggcattggataaatacacccgtttgaaatgggagaaattggccaaaacaaaggggctgcaggccccatgcaagtctgaaatccaataggccagtcataaaactttcaagttccatagttatctcctttgactccgtgtctcacatccaggtcacactgttgcaagaggtgggcttccacggccttgggcagctctgcccctgtggctttgcagggtatagccccgctcctggctgctttcacaggttggcgttgagtgtctccgtcttttccaggcacacgatgtagctgcaggtggatctaccattctgggttctggatggtggcccttttctcacagctccattaggcagtaccccagtggggactctgtgtgggggctctgaccccatatttcccttctttactgcattggtagaggttctccataaaggctccacccctgcagcaaacttctggctggacatccaggcatttgcatacatcctctgaaatctaggtggaggtttccaaacctcagttctttagttctatgtacccacaggctcaataccacatggaagctgccgaggcttggggcttgcaccctctgaaggcacagcctgagctgtgtaccttggctcctcttagccatgactggagtggctgggcaccaagtcctaaggctgcacacatcaggggggccctggacccagcccaggaaaccgtttttccctcctaggcctgtgatgggaggggctgctgtgaaggtttgtgatatgccctggagacattttccccattgtcttggaattgggctccttgttacttttgcaagtttctgcagccggcttgaatttctcttcagaaaatgggtttttctttttacattgtcagactgcaaatttccacactttttttttttttgagatggagtctctctctgttgcccaggctagagtgcaatggcatgatctcggctcattgcaacctctgcctcctgggttcaagcaattctcctgcctcagcatcccgagtagctgggattacaggcacccgccatcatgcctggctaatgtttgtatttttgtagagacaggatttcaccatgctggctagactggtctcgaattcctgacctcaagtgatctgcccaccttggcctcccaaagtgctgggattacaggcgtgagccactgcgcccggccaatttccacccttttatgctctgcttcctcttgaatgctttgctgcttagtaatttcttcccctagatgccctaaatcttctctctcaagttcaaagttccacagatctctagggcagggtcaaaatgctgccagtctctttgctaaagcatagcaaggatcaggagaacagcatgggggaaccgtccccatgatctaatcacctcccatgatgtcccttccctaatatgtggggattccaattcagattacaattcaagatgggatttaggtggggacacagagccagaccatatcagtaatctcttgggctaaccaataaccaatgtattcttgtattttttctttgaaattttataaatatttataaatttaaataacatttaaatcaaaatggattatgttgtaatcattactctgccagttttttttttttaatttttaaatttattttttgtagagacaggatctccctatgttacccaggctggttttgaacccctggactgaatcgatcctccggctttggcctcccaaagtgctgggatcaaagtttgttaatttgatagctaaaatatattttcatctgcatttcaattacaattagaagctatgtatcctgcaacatattttccagcaatttgtgtattttcagtgtgtctttctgagtcctttttgggtatgcctggactagtttgtctttttcctgttagtttgtaagggctcttgttattgtgggacctttcctctttgtccatcacctgtattgtataaatattttgttacaggctattgttttcctattggcatattaacatttgagtcttgttcttactagtatgtagttttgcaaggttgcatttgtagcttgcatactgtctcctatgtttttatttactgtaataagtattttcccatgtacccacgtaacctttttaattaaacctataaatgtccaatcgatagttccctgtgttggtgggctataatcacataattattatctgtggtttgacatttgggttgctgtgttttctttctccttttttttttttattattatttttgagacggagtcttgttctgtcgcccaggctgaagtgcagtggtgcgaccttggctcactgcaagctccgcctcccaggttcacgccattctcctgcctcagcctcccaagtagctgggactacaggcacctgccaccacgcctggctaatttttttgtgtttttagtagagacggagtttcaccgtgttagccaggatggtcttgatctcctgaccttgtgatctgcccacttcggcctcccaaagtgctgggattacaggcatgagccactgtgcccagcccctttctccctttttaacttttttgagacagcatcttataccatcacccaggctggagtgcattgcgcaatcttggctccctgtgacctctgcctcctgggttcaggtgattctcctgcctcagccgctggagtagctgggattacacatgtgtaccatgatgcctgattaatttttgtattttcagtagagatggggtttcaccatgttggccaggctggtctcgaactcctgacctcaggtgatctgcctcccaacgtgctgggattacaggcgagagccaccatacccagtcatttttatttttcttttaaagaaaacactgtcctgaataccacatgggtagagtgcgtattggcttatttccttagatgatgttctcaggagtggaatgaataacatctgaaaaggcttcactctagccattgtcttattttctaaaagtgagctggcccagctcaccgttctagcagggtctaaggttacttactgctgtggttattattcagagtggacgatggtgcatgttaatgtcaggcacagcagggcgcggtggctcacgactgtaatcctagcactttgggaggccgaggtgggcggatcacgaggtcaggagttggagaccagcatgaccaacatggtgaaaccccatctctactaaaaatacaaaaattagctggcgtggtggcaggcacctgtaatctcagttactcgggaggctgaggcgggagaattgcttgaacccaggaggcggaggttgcagtgaactgagattgtgccactgcactccagcctgggtgacagagagactttatcttaaaaaaaaaaaaaaaagtcaggcttttctagggttcctccatcagccttgtaaggctggagacccgtggccaggaagaaaattggagctgtctggcactgggaagggtaacccagtagttataattaggttggcttatctgcgagccctttgataaggcttcactaatttactaacccaggatcgcatgttagatcaggatctctctgagtgctgcaattgtagtttgcttttctctctctcttttttttttttttttagagacagagactcactctgttgcccaggctggagtgcagtggtatgatcatggctcactgcagccttgaactcctggcctcaagcgatcttcctgccttaccctcccgagtgtcttggattatagatgcttgtcaacatgcccagctaatttttaattttttttagagatgaggtcttgccctgtcacccaggctggagtgcagtggcatgaacatagctcactgcagccttaaacttctggcctcaagcagttctcctgcctcagccttccaaagtgctgggattacaggtgggcaccactgtgcctggcctgcagtggtttaatagggctctttcatctttaactttggtcccctgccccctgagatccgtggagtgagccgtttgacgcttggtacttgggacaaagctggcctatgtccagttctctgcatacttggtaggggagtgtttggagaaaaggctcacctctgagtcacaccctctatattctccaaagggccatggggatggggtggaggaggctggggtgaagagatgttgtagctccagagaaagccagggaggtgtatgctgggtgaagaggccaagttcaggagcctaggtttgaaaatcagtatagacgattcaggttaattcaccctgttgttatagagcatctgtctgtagggtggccaggtctgggtgagtctcttggacaagatgggtatcaggtttcagctctgaaattggactgatatgtggggagattcattctgcagttttatttgtagtttaggtttaagaaaacttggactgggcactgttgctgtcgtctgatcccagcacttagtgatgctgaagtgggaggatcacttgagcccaggagtttgagaccagcctgggcaacagaaagaccccatctctacaaaataataataataataattattattattattattagctgggcatgatgggacatgcctgtagtcccagctactcaggaggctgaggcgggaggtttgcttggtcctgggaggttgagctgcagtgagctatgattgcaccactgcactccagcctggacaacagcatggcactgtctccaaaaaaaaaaaaaacaacaaaaaaaaaacttgtttaactacctaaatcatagcatttgtgtgaagccagactatcacaactctgagaactgctgacatatacatattttggaagttccaggttttctgttactataaacatggtagagattgaattacttaaagggacgtcttttctcctactctttgtcttgtctgatgttataaggggtacagtatagaatgaaaacagtgcagaaatgagtgaaacatgaaaatcccttctagagataattttcttttattatttttttgagacggagtcttgctccattgcccagtctggagtacagtgatctcggctcacggcaacctccacctcccaagttcaagtgattctcctgcctcagcctcccgagtagctggggttataggtgtgtaccatgcaccaccatgcccggctaatttttgtatttttagtagagacagggtttgctgtgttagccaggctggtctcgaattcctgacctcaggtgatccgcctacctcggcctcccaaagtcctgggattaccggggtgagccaccatggccagcctcttctagagacaatcttattggcaggttgatgtttttaattttcagcctctcttctccacagatcctaaagatatagtaatttttttttttgagacagagtcttgctctattacccaggctggagtgcaggtggcgtgatctctgctcactgcagccttcacctgccgagtagctaggactgcaggcatgcaccactatgtctagctaatttttgtatttttagtagagatggggttttaccattttggccaggctggtctcaaactcatgacctcaagtgatccacctgccgcagcctcccaaagtgctgggattacaggtctaagccaccgtgcccagccataaatacatggtattttttaagaacaagaacgggattctacaaaaacatatatatgtgtattttgagacaggatctcctctgttgctcagggtggagtgcaggggcacgatcatggcccactgcagccatgacctctcaggctcaagcaatcctcccaccttagcctctggagtagctgggaccacaggtgcccaccaccatgcccagctaatattttttcttttttttttttgtattgaaaacagtcagccaggtgtggtggctcacacctgtaatctcagtacgttgagaggccgaggtgggcagatcacttgaggtcagtagttcaaggccaggctgtccaacatggtgaaactccatctctactaaaaatacaaaaattaactgtggtggcgcttgcctataatcccagctactgggaagggggaggcataaggatcacttgaacctgggaggaggaggttgtagagagccaagatgatggcactgcactccagcctgggcaacagagcaagactctgtctcagaaaaacaaaacaaaacatatagtctttatttttttgtttgcgtgggctggtgcatcttgattatgatgcatttttgttaattgatatttaattgcagatgaaatgtaacatggatctgagtaattgctgataattgtttcctctttaggcagctggtcagtcttttttttttttttttttctttttaagagagtttctgtcttgttgcccagactggagtgcagtagcgtgatctcggctcactgcaacctcctttgccagggttcgagtgattctcctgcctcagccccccgagtagctgggattacaggcatgtgccaccacgcccggctactttttgtatttttagtagagacgggttttgccatgttggccaggctggtctcaaactcctgacctcaggtgatcccccctgcctctgcctcccaaagtgctgagattacaggcttgagccactgctcccagcccatagtcttttttttttttaaacctctgtgtacaggtaggtcctggggaaattcgaggcaagacttgggtgagtgggtatcttagaccctctcaggagctctttgcaggaggtagaatctccgagggtcagtgcccatgaatgggtcccatggcctgactggtcccattcaggtgacagtctctgagggtcctgcatagcccttacctgggctccatgctgggaatcgagcggtatacagagcatggttccctgccttccttgagccccagtcttgttggggaaatggccaaataaatgaataatcatcaggaagtgctatgaaggggagctgcgtggtgcccggtgagtgcaatagcggggtttcatctggttggagagaaaaaaggagactccttaagtggggaacccgtttgatgatacaggtttggctatgtgtgtcaaagaccccaaatatagtgggttaagatacaagctcatttctctctcatgtaaaaatcccagctggtgtggcagctctgtccccaaaataatcagggtcccaggcccctcccatcttgttgctctgctgtcctcatctgcatggatcaagatgatgcatctccatgtccacatggcagccagtaggaaagcagagtaagggcacaacctggaggttgcctacgtctctcctcgtcacatcccattggcttgtacctagtcatgtggtgcctctagctgcaaaggaggctgggaaatgtagtttcctttctaagcaggatgtacccagctgaagatgttactcagggatgagggagagttgatactggagcgcagctagcagtttctgctgtataggcaaaagcagaaggtaagaatgttctgggcagtgggaaatgcatgtgcagaagcactggcttaatgaggaaggccactgtggctggagtcaaagagtagggaagagaaaaagaaccagaaggaggctgagaattgggcctgtaggacttggatcctgtgggaagccttggcagctttctttcccccctccttgcttaggcattagctctaagacagggatatttacaacacaattatttctttaaaattatatatatattttaatttgtacagatgaggtctccctgtgttgtccaggttggtttcaaacccctgagctcaagccatcttcttgcctcggcctccgaaagtgttgggattacaggtgtgagccattatacctggccttcaactcagtccctaaagacaactccttctcaagtgttggaaagaaccaatgactaatcacttctagtctgccttatccccatcttgcttgtgtgactttggtaagagtttgtttgtttatttaaaggagcagagagtttaataggcaagaaggggcaagaaagaagggagaataagatcccctgtatagagacggaggagggctccaaagctgagagagggaaccccagctgccacagatagcagctaggtatatgtacagaggctggaagaggcagtgtctgatttgcataggcctcaggggattggtttgactaggcatgtctttcacgtagcgcatgaaaaagctggccctcccacctagccttttaatatgcaaatgcagggtaccatgatctgcacacttggggaggtgtggtggcggccatgttgctaggaacatgtggggaaagggcaagaaggctgtgggaatcgccatgtttgggtggacccagtttctaatggcttgcatttgcatatcaaaggttgctggcctggctctaagagccggggctttacaagaaacttttccggagttgctttaaaaaccaaacatttcccaaggaccccttttcctctctatttgcctaaaataattgcttaactcctacattaccccctgtggagatgccacattaactgctgttagggggttttgggcgacgacttcttctggctacttcctggtgaaaaggggcgttgaatggggaacagcagctagggctcctcctggggtggatctaagggtcctcggaagaatggcgtgtccatgtgtgcttcaggttacagcaccattttgagtttgattgcttcagtctgatgaaataatttcctttcctggccaacacaccaaaatgatacggctccgatgagtgggggaacaccagggttcttggtcctcatgccggtttagataaaatgacacagacacacgtggagtggttttaaggagtggagagtttaataggcaagaaggaagggagaaggaagaaggtcccctgtacagagacagagggtggggggctccaaagctgagagacggaacctccaggagttgattttataaataaaataacatgcgttgaggtcactctgtgttgtgtggtatgcccagccctctctgcacataacttgtttcaggcccacagtcatgctgggtggttgctgtaatgactttttattttaaatggggaatctgtgacacagttaaacatgcgcaggatcatgtcactagcaaggagtggacacggtattcaaacccagcaggttgactcaaagcctgccctttccccagctgttttgcccctcagtcatttgagtctagtcttcaggattttgacatctatctcttaccttgtatctgttaggattgcatctggcttcaagaaacagccctacttcagcagcctaagcagaaaggtattcatttgtttattttttacatgtcaggaattccagtacctcttggagttgctggcattggattagtgatgcagggttgttaggactgacatctctgctgttttcttgtcttttcctcaaggcccctaaatggctgctacagccctaggcaatatatctgggttcaaggtaggaagagggagggattgcaccagcctcatgggttcctttctattcaggaaagtccaagccttcttcaaaggctcttctgtccacattgcagacttctggtcatgtctccttggctgaaactggattacatgaccacctctagctgcaagggaggcaggaaaaatgagcatttggttttatgcttctctaggaggaaacagcaagggagaaacttttgagtaagccagccaatattgtccaacatgtacttattttttaactttttttttttttttttttttttttgaggcaaggtctggctggctctgttgccgaggctagagtgtggtggcacaatctcagctcgctgcaacctctacctcctaggctgaagctatcctcccaccttagcctccagagtagctgggactaccacatgcaccaccatacctggctaatttttatatttgtagagatggggtctcaccatgttgcccaggctgctcttgaacttgtgagttcaagtcgtctgcccacctcagcctcccaaagtgctgggatgacaggcatgagccatcacactcagctaatgtttttctttcaatcaattcactttttaagccttaacaaagttatcgcaaaaggaagtttcatatcactttagaatgtctttgaagtcacaggttggttatatttatgtgcttactttaatagctattaaagtaaatatagcactactaagaaaaaaagatattctttaaatcgcctattatcagtggttcttaactctggatgattttgtctccaggggacatttggcaatgtctggaaacatttttggctgtcacgatggggcagggagcgcacgcctagagtctagtgggtagaggccagggggtgtgctaaatatcctacaatacaggatgggctccataatgaaaaatcctctggtcccaaatgtcagtagtactgcagttgagaaaccctggcatggacgcaatccacctgctgccaggagttatatacaagccatgttagggtaatgctgcaatatgtccatcgtgattgtgttttctcctgggtgactatcagcaatggtgtagcctgcttgttggttttcaaggtccattctcaagatactatcagatctccagcaatcgtgtgatgcagtttaaaatgttcatgtgagctgggcgtggtgactcatgcctataatcccagcactttgggaggccaaggctggagaatggcttgagcccaggagtttgaaaccagcctgggcaacatagcgagacccagtctctacacaaaattaaaaaaaaaaaaaaattagcccggtatgatggtgcatggccatggtcacagctactcaggaggcagaggtgggatgatcacctgggcctgggaggttgaggctgcggtgagccacgattgcaccaccgtattccagcttgggtgacagagtgagaccctgtctcaaaaaaaagaatgtgcatatgaattcaagatatgtcccttatagagactggtgaggacacagcttattgaccctgaagctgaagtggttgaaatgatagccctcttgccaggcaaatcctatgtgagtgcttctaaaagaacactgtaccttgcagagagtattcctgggacctggcaggaatcagggcctcttggtgaccacatgctttggaaagggctgtgctttggcaagtgggagattttattatttattttctcctgtctgcctcggtttggcaaaaacaaacctggcctgggcatgggccttgtggagacaagaaggcagcttgagattatcagagatcaggctgctggtgggtttgcctgagctggcctggtcaggtagcttgacaatgatgctcagacccccattaaagttaattgagcggttacagagtgggagtggggagtggggggtgtggtgactgcctgtctccttgagttggcgtggctaagaagtaagggaattttttaacttttccttcttaattctggaaacttagaaaaaagcctctcaccatcccttaatcattcagttagagagaccaggctgttgatatggacatgctgcgtttcatggaatcctagaggccagtatttatgacatacttcccagtttcagagatgttaggatataaaaatgtagccagcagtgtttacaggatgggctaatcgagagacacagacaaatatcaaagatagcaaaataggaagaaacagagtcttagaatcaatgcagtataataatagcttctagtttctttctgtttttctttttatgatacagagtctcactctgtcgcccaggctggactgcggtggcatgatctcggctcactgtagcctccgtctcctgggttcaagtgatcctcccatctcagcctccaagtcactgggattacaagttgtttgccaccatgcccagctaatttttgtatttttaatagagacagggtttcaccatgttggccaggttggtcttgaatgcctgacctcaagtgatcccccccagccttggcttcccaaagtactgggatgacaggtgtgagccaccatgcccagcctccccctcactcttaagcacagctcttcggcagtcagagatgttgcctgctgtatttctcgttctgcttttacacatggtttaaaaatcctcgcccaagaatgtaagccccatggctagtgctacctgctacctttaggggtggcctctcctggggtgcaggaggttgcacagttcgttttgtgacagcagggtcattttttaatcggatcatctgccccagtttgcttggctcttaggtgcttgggagttctcctggttttttgctgttgtgaaatggcccagcttgtacacgttgttccttttcttgctggagttatttcctttagactcctgtccctaaagtaggattgttgggtgaaaatggggtatgcgtggttaggcttttctctgcctgctttctggattgctcttcagatagatttaatcaccttttatttatgttttgtggtggttttttttgttttttttgtttttttttgttttgagactgagttttggtcttgttgcgcaggctggagtgcaatggtggggtctcggctcacagcaacctctgcctcctgggttcaaacgattctccttcctcagcttcctgagtagctgggattacaggcatgcgccaccatctctggctaattttgaatttttattacagacggggtttctccatgttggtaaagctggtctggaactcccaacctcaggtgatctgcccgcctcagcctcccaaggtgctgggattacaggcgtgagccgccacacctggccaccttttatttgttgaatgagtgtttaataagcatgtcctatatgcatcaggagaattaaatggacatggtcttgctttggggggaaatgacaggtaggagagaaagagacacttagaactcaacagaggccagacgcggtggcttacgcctgttatcccagcactttgggaggctgaggtgggcggatcacctgagatcaggagttcgagaccagcctggccaaaatggtgaaatcccgtctctactaaaatataaaatcaatcaggcgtggtgatggcacatgcctgtgatcccagctactcgggaggctgaggcaggagaattgcttgaacctgggaggcagacattgcagtgagccgagattgcactactgcactccagcctgggcagcaagagcaaaactctgtctcaaaaaagaaaaaactcaacagagaaaaggcggatcgttaaggcttctttggcacttcctaagtgccagggactgttgttaatgcctttgaagtgctaataatgacttaatggtgacaagttccctgtgaagcagggactgtgattgtttctaccttatgggtggggaaaggaggcagagagaggtgaagtcacccagctagtaaatgacaggactagactgaaacccaggcagtctgtctccagggcctggccggtaccccatgctccatcttgccccataaacaccctggggtgggccagagaggagtcttttccaacaggctgtgccagatgactttggctaatcttggaggctggaggattagtcagtctactaagggggcttcagcattttggcacgtggctttatgagctgtttactccaacagtgatgatgacaatagccatagtagtgataatactatggtagaagtaactgcagcaaactcaacccctaacgagtattctatcttcccaacattgtgtgcaatagccatgagagatgggtgttattcttttaatttgacacacgggaactgaaagccagagagattgggtggcttcccccaggccacacagcctggaagtagtaggacagggactcgagcccagatctgctgccccagagcctgtgcccttgaccaccaagtcatggtcactcctttcaaccctgcctgcccctgggccatctgtgttgtgatgccggctggccaggatggggagtgaggatttcagtttgtcatagggcagggagatgggtgaggcaggacactccttgagatggaaggctctggggtcgggggagagggagtggtggagactggggtgtctccgaaggagtgtttgaagatgacggtggtttttccagtttcctgttcttagctatattcaagaaaagggtaagccagaaaatttccctctgagtttcacaacttctgggagcttttgcaaagtctgggtgatgcagcattttcctggtttgaatcctaagtgaagtttcattttccttcacttaactcattctggctctggcctgtcttcccagctgtattggccatctggtcctcttctggctctttgtcccatttattattatttatttttatttttaacagagatggggtctcactgtgttgccgtctgttctggaactcctggacccaagtgatcctcctgcctcggtctcccaaaatactgggattataggcatgagcctctgtggccagcttataccccctaagcttgtgactatcttctatgtgtgtccctcttggagtgaggttccctcctgtctccatgttggcaaatcttagcaccttggcccttcgagatggaggtctgtgttgcctaggctggtcctgaactcctggtctcaagtgatcctcccatcttggccttccagagtgctgggattacaggtgtgagccactgtgtccagccaacccttcttagattttacttacttcaagaagcctgctttgacctctcaagtggaaataacaacttccaggaatagagtgatcactgggcatccatctgttgtcacatgaatgattttatccatattaaggaggcattacatgcagcagtgagctaacctgcctgtgttgaagttttcttctttttacaggctgtacaaccttgggcaagttgctttacttctctgtgccttagtctcttcctcagcaaaatggaaaaaatactacccatttcaaatggggtgaaaatgaaataatatataagtctcgtcttcacaatgtctctgatgaaaagcaggtattggttgcacatggtgctcatgcctgtaatcccagcactttgggaggccgagcagggaggattgcttgaggccaggagcttgagaccagcctggggaacatggccagaccacatctcttaaaaaaaatttagctaggtttggtggcatgcacttgtggttctaactagtttggagcaggtgaggagggaggatctcctgagctcaggaggttgaggctgcagtgagctgtgattgcacacgactgctttccagcctgggcaacagagtgaaaccccatctcaaacaaacaaacaaacaaacaaacaaataaacaaaaaacaggtattgtccttgctgtatgaatgaggaaagtgagttttcctttttgctttgtgaaactcttttctggatatttcttgccttttatgtgtatctctttggtggtactctgtgcttttaaaatcttttgtaatggccatttatggacaaatcgtatcttatattcaagattctaagctttctgagggcaggatataaatgtggttgtttctggttcaagtcctgatacaagcaaagctcagtaatttttttaaatgaatgggtgggccggtggttgggtcttcagagtcactaaatactggtggcaggagtgggaccacatagaaaaaaatattaaggcagtggatctcaatggggagtgatctgcctctcagaggacgttcattgatgtctagagacatttttgttgtcacagtttgggatgggggtgcagttggtgtctgttgggttaggatcaggaatgctataaacatcctgtgatacacgggacagacgtatccagcctaaaacgtcagtagtgttgagggtgagaaaccctgggcttattaaggcaacaagcaacatattaatagcaacaggagaaaacatgcatttaaattttttttggccaggcgtggtggctcacacccgtagtcccagcacttcggggggcccaggtgggcggatcatgaggtcaagacatcgagaccatcctggtgaacatggtgaaaccccatctctactaaaaatacaaaaattagttgggtgtggtggtgtgtgcctgtagtcccagctacttgggaggctgaggcaggaaaatcactttaacctgggaggcggaggttgcagtgagctgagattgcactactgcactccagcctggagacagagcaagactctgtctcaaacaaacaaacaaacaaacaaaaaaaaaacaaaattttttttccacaaatgtgaagtagtctagatgagatacgctcttcctgagatgataaagtgaggtctaagtgtatttattaattcttttgaggagggtgttaggtgctaaaggcagcacgtgtaaggtgaaaattgcgtatagccaaaatgaccctggggcttattctctctctctctctcttttttaataaacagcttttttgttgagatataattcacataccatatgatgcacctataaagtgtgcaactcagtttagtacattcagaattgtgcatgtctcctgtctccaggtaggcaaatcttagcacctcggcccttcttagattttattttttagagatgggggtctcactatgttgcccaggctggtcttgaacttcttggccttcctcccatcttggccttccagagtgactatattcaatattcaaagtgactgtagtcaacattagatatttttatcaccctgcttacttgtttttatttaagacctggtgtggtgtgtgcctggccttgtgatcacaaatgctagttacactgaattgacattttgctgagactcgttctgaggtccattcatagatgccctaggtacttcctgattacttgccacaccccaggaattctgcacagtgagtggggagtgacattttgagggacagcatcagtacattcactgcgctaaagaaacagtctggggagagtgagacatcgaaaaaataacatataaaataaacatctgatggagacataggaagatgccaaccttcaacaatgtttgacttggagcaggggttggcatgctttttctgtgaagggttaggtagtacatattttaggtctctcaggcccaggggcaaatagtctttcttataatatgtatttaaaaattggccaggcatggtggcttctgcctgtaatctcagcactttgagaggccaaggtgggaagattgcttgagcccaggagttcgagaccagcctcagcaacaaagtgagactctgtttgtattagtctgttctcacgctgctataaagaactgcccaacactaggtagtttataagggaaagaggtttaattgactcacaattccacagggctggggagacctcaggaaacttatactcacagcagaaagggaagcaaacatgtcctccttcacatggtggcaggaaggagaagtgctgagcaaaaggggaaaagccgtttatcaaaccatcagatcttgtgagaactcactataatgagaacagcatggaggtaactgcccccatgattgaattgtctctcactgggttcctcccacaacacatggggattatgagaactacaattcaagataagatttgggtggggatacagctgaaccatataattccatggccaaatgatatcgttctgcccctcccaaatctcatgtcctcacatttcaaaacacaatcatgcctttccaagtgtcacccagagtcttagctcattccagcattaacccaaaagtccaattccaaagtctcatctgagacaaggcaagtcccttctgcctattagcctgtaaaactgaaagcaagttagttacttcctagatacaataggagtacaagcattgggtaaatacacccattccaaatgggaaaatttggccaaaatgaaggggctgcaggccccatgcaagtctgaaatccagtggggcagtcatttcttaaagctctgaaatgatctcctttgactccatgtctcacatccaggtcatgcttatgcgagaggtgggctctagctatggccttgggcagctctgcccctgtggctttgcagggtacagcccccatcaaggggctttcacgggtttgtgttgtgagtctgcggcttttccaggtgcacggtgcaagctgtccatggatctaccattctgcagtctggaggatggtggccctcttctcacagctccactaggcagtgtcccaatggggactgtatggggcctctggccccacatttgccttctgcactgccctagcagaggttctccatgagggctccactgctgcagcaaacttctgcctggacacccaggcatttccatgcatcctctgaaatctaggtggaggttcccaaaccttgattcttgacttttgtccacaggctcaataccacatggaatctcctaaggcttttgaggcttgcaccctctgatggcacagcccgagcagcattttggccccttttagccacagttgaagcaactggaacaaagtgtaccaactccctaggcagcacacagcaggggggccctgggcccggcctatggaatcattttttcctcctagacctctaggcctgtgatgggaggggctactgcaaaggtctctgacatgccctggagacattttccccattgtcttggtgattaacatttggttccgttttacttatgcaaatttctgcagcaggcttgaatttttccccagaaaatgggtttttcttttccgtcacatcatcacccttccaatgtttcaaacttttatgctctgcttcctcttaaacactttgttgcttagaaatttcttctgacaatcatctaaatcatctctctcaagttctaagttccacagctctttagggcaaaggcaaaatgctgccactctttttgcttaagcatagcaagagtcaccttggctccatttcccaagaagttcctcatctccatctgagaccacctcagcctggacttcattgtccatatcactatcagcgttttggtccaagtcattcaataagtccctaggaagttccaaactttcttacatcttgctatactcttctgagccctccaaactgttccagcctctgcctgatactcagttccaaagttgcttccacatttttgggtatctttacagtagcaccccactcccagtaccaatttactgtattagtttgttctcacgctgctataaagaactgcccaagactgggtagtttataaagggaagagatttagttggcccacagttctgcagggctggggaggcctcaggaagcttgtaatcatggtagaaggggaagcaaacacgtccttcttcacatggcggcaggaaggagaagtgctgagcaaaagtgcttcttttgctgagaagtgttgagcaaaatcagatcttgtgagaattcactgtcacaagaacagcatggaggtaaccacccccatgattcagttacctcccactgggtttcttccatgacatgtgaggattatgggaactgcagttcaaaatgagatttgggtggggacacagccaagccatatcactgtctctaccaaaaaaaaaaaaaaagccaggtgtggtggctcatgcctgtatcccagctactcatgaggctgagatgggaggattgcttaagtccaggaggttgagactgcagtcagctatgaccacaccactgcactccagtctgggcaacagagtgagacgctgtcaaaaaaaaaaaaaaaaaaaaaggaaatccattcttagcctgtgtgctgtacaaaagcaggcagcaggctgaatttggcccacaggctgtggttcgccaacttatgacctatacaaatggcaattcatatggttcatcctagcgataactgtacatggtgtattagatactatatagcatgttcatatcaaatgtcatataatgtataaggtaacatatacagtataaaatagtgcctgagaaatatttgatgaaaaaatctgataagtacttagcaggcacagtacaaagtaccatgaagttgttaaatgggggatcagggtgtttgagaaaggggtggggagataggtgggcctccctcaagaaggaatgtttcaactgtgagctgaaggatgcccctgcattgcatgtcagggcagtgatggggagaaagactccaggtagagggaacccactctgcaaaggccctgagtcatgaaggggtccctggaacagtgagttggggctgaacccacaagctgcagttgtggggattgtgatccatcctgagagctctgagaacctggaatagttttcagcgcagtgtgaagggactggggctgtgttttgaagatatcccctgtctgcggttgggaggggagtcaggaaacctatttggaggctggggttttcacccaggtcatgcagataagatttattaggtgtggaatgaactgagcaaatcacatgtcttctaatggtacaccacactttttttttttttttttggttttgagacagtcttgctctgtctcccaggctggagagcaatggcatgatcacggctcactgtagccttgacttcccaggttcaagcaatcctcctacctcagcttccggagtagctgggactacaggtgcccactaccatgcctggctaattttggtatttttattggagacggggtttcatcatgttggccaggctcctctctaacttctgacctcaagtgattcgcctgcctcagcctcccaaagtactgggattacaggtacaagccaccgcgcctggcctttagtgatattttaaagactaaattcccttagagatgcctgggtctgcatttattgctactgttctgtttctcactgtgtgtcttgaggtcatcaaaagtaacctgggccttttcccttgttttctgcctcctctaggcttatgagccattaagcaaagccggattggtgtgtgggtcaggctcttcatgttttctttagcttaataagcagtttctaagggaactcattgtgtcattgtttagaatagcaaaagatgagcagcctcccaagtggcaatcagtaggggctgggtgaatacagtgggttccaccccttccgtggtagggtgggatgcttgcagaaggacataagacgaggaagccctttgtgcacagatgtgcggcagcctccaaggtccagtttttaagtgaaaacgtggagatccacttggtatatttggtatgttacctctgtgtaaaaaagcagacaagtaagaattacgtagttgtatttgctgtatttgtaagaaattccagagggataaatgagaaactaaaagaggcaattgcatttgggcagagtaactttttattgtttaccttgatatatactttttttttttttgagatagagtctcgccctgtcaacaggctggagtgcagtggcgtgatcgtggctcactgcatcctccgcttcccagtttcaagcgattctcctgcctcagccttctgagtagctgagattacaggtgtgtgcgccaccaagctcagctaatttttggtatctttagtagagattgggtttcaccacgttggctgggctggtctcgaacccctgacctcgtgatctgcccaccttggcctcccaaagtgctgagattacaggcttgagccaccgcgcccggcctatatatgtattatataaacatatgcacacgcatgcatacgtacacacatatatattttttaaaaattgagtcatggccaggtgcagtgtgggtcacacctgtaatcccagcactttggcaggtgaaggtgggaggattgcctgagctcaggagtttgagaccagcctgggcaacatggagaaaccccttctctacaaaaatcacaaaaattggctgggcgtggtggcatacacctgtggtcccagctgcctggaaggctgaggtgggaggattgcttgagcctggtaggtagaggccgcagtgagccatgatcacgccactgcactccagcctgggtgagagagtgagactctgtcttaaagcaaaaacagagtcatatatttcctattaaggtgaaatttaaaaaataaattcctatattccatcatccccagcttctgccattctaaagcattttcctaagcagctccactgtggatgtagcgggtatttcagaaaggcattagaaatgccctgggagggcagaacccggggcttcactggaggtgctgttgggctcagtctgatgtcaaggcagggacatggcaagggtattgagatgtgaacaagcattactcagcaaggtgacatgtgttcatgccttgatacacttgtttccccaccagctctatttttgttgcctgctctattggtttctttttcttttttttttcttttgagactgagttttgcttttgttgcccaggctggagtgcaatggcaccatctcggctcactgcatcttccgcctcctgggttcaagtgattctcctgccccagcctcctgagtagctgggactacaggtgtgcaccaccatgcccagctaatttttatatttttagtagagacggggtttcttcatgttggtcgggctggtctcgaactcctgacctcaggtgatcctcctgctttgggctcccaaagtgctgggattacaggtgtgagccactgtgcccagtctctattggtttcttattgctggtattgccatcaacttggtgactgagaacaacacacatcactctagttctcgggagtcagaggtccaaaatgtacggctggtgttctttccggaagcttgcagggagaatccatggcctggccctgtccagcatcaagaggccacctgtcttcctcaattcgtggtttcatgtccctccacccctgcttgtgttgtcaaatctcctttactttttttttatttttgagacggaatctcagctcactgtagtctctgcctcccaggttcaagtgattctcctgcctcagcttcctgagtagctgggattacaggtgcatgtcaccatgcctggctaatttttgtatttttagtagagacggggtttcaccatgttggacaggctggtcttgaactcctgaccccgggtgatctacctgcctcagcctcccaaagtggtgggattataggcatgagccaccacgccctgcctcaaatctccttttctgactcagatattcccaccgtcctcttgtcccttataattccctgtgattacattgggcccacctggatcatctaggacaggggtccccaactcctgggccatgaaccagtagcgagcagtctgtggcctgttaggaactgagtcatgcaacaggagctgagtggcgggcaagccagcattaccacctgaattccacctcctgtcagatcagtggctgcattggattctcacaggagcgtgaaccctaacgtgaaccgtgcatgcgagggacctaggctgtgtgctccttatgagaatctaatgcctgatgatctgagggggaacagtttcatcctgaaagccaccccccgccatccctggcaaaactgtcttccatgaaatccatccctggtgccaaaaagcgtggggacctctgatctgggacattctccccattccaaagtccttaatgatacctgcagagtcccttttgccatgaaaggtaagagactcaggttctggggacggggatgtaggcatctttacgggctattctgtgtactgcacctgttcagcttagttccaggcacatagtaggggctcagtacatctttgttgaatgacacaatcaatcatttggttaggctagagaatgtggaaggaggccgggtgcagtggctcacgcctgtaatcctaaggctgaggcaggtggatcacttgagctcaggagtttgagaccagcctggacaatgtggcgaaaccccatctctcctaaaaatagaaaaattacctgggtgtgatagtgtgtgtctgtagtcccagctactcaggaggctgaggcgggaggatcacttgagcccagaaggtggaggtttcagtgagctgagatcatggcactgcagtccagtctgggcaacaaaacgagaccctgtgtcagaaaaagagagaatgtggagggatattatagcaagaagtggatctggaagttttactagtagtggtatttattgagcacctactgtgtgctctggctcatgtttaacaaagtgcttatttgcataatgttagtattcccattttacagatgcggaaactgaggtttagttgctggcctagtattacagggtgaggagctgaagccccatctgcctgacgaggggtgtgttggggatgtggactagaagcttggtcagggagggattctgttcaaacagggctgcttagctttggcactgttgacatttggggccagatatttcccgtcgtgggggctgtcctatgtattgtggccattaagcagtatccctggcctctgtccacagagtgccaatagcactaccctcttcctaagttgtgaaaacccaggatgtttccaaatgttgtcacatgtcccctgagtgacaaacttgcccccacttgagaaccatggtgttgaaacatagatcacggcacatcaactccatgctcctcaggtcaccctgcgtgaaagtcagaatccctgcggtggcctgtgcgtcccgcactgactgtctcctccctgccttcttccttcctcgctgtcttcactgcttgttattcttcagacctgttggcctctctgcggtttctcagaaatgccaggcctggtctgacttcaggacctttgcactggctgttttctctgcttggtgtgcccttcctccagatggccatttggtttactcctctgtttccttccatcctgtatttgtttatttatttttaattgagatggagtctcgctctgtcacccaggctggagtgcagtggtgtgatcgcagatcactgcaacctccaccacccaggttcaagggattctcgtgcctcagcctcctgagtagctgggattacaggcatgcactaccacgctatgttggccaggctggtcttgaactcctggcctcaagtgacccacttgtcttggcctcccaaagtgctgggattataggtgtgagccactgtgcctggctcaatcctgtatttaaatacccgtcctcagcaaggcttgccctcttctctgagtgcttttcatcacacatgtcttcatatcctctcctttctaaaccatctgtctcttctctttaggctgtcagctccaggagggccggcccttggtccctattgttcactgctgggccctcagccctaggaaccgtgctctgtaaatggatgaatgctgtctgtcctgttactgcagtgtccccagacatatccctatgcccagcacatgcctgacccctcacaagaccctggaacatgactaagggatttatttggtgaaacatgagagtctgataagaggagaggaagtggctggggagcaaccttgcaaagatagccagggttggatggagaaaacgagggtgagtgtcagcttcataggacgggccttccacgagaggcctcatggtgcttgggagagttggggtgaaagcaggttggaacaagatgcttgctgctgacatttgggcactgatgggcagcctgacctctgctttctttttagtgcttaacaacactgaagccctgttaagacaggattcttaggactgggcacagtggctcatccagcactttgggagccctgggtgggaggatcatttgagccccaggagtttgaggccagacagggcaacatagcaaggccccatctctggaaagaaatacaaaaattaaccaggcttggtggtgtgcacctctagtcccagctacttgagaggctgaggtgggaggatcacttgagcctgggagttcaaagctgtaatgagctataatcatgacattacactccagccgaggagacagagcaagactctgtctcaaaaaaaaaaaaaaaaaaaaaaaattagttttgcatgtaactgtgttcagttctgtgtcttggacgtgaggatttgtggtacccgcctggatagagcaaggatggccgtgcccctgccttcctgggtgatggggataagtctggaaattgcccctgtgatgttactgggctttattcttagctctgctgagttagggggcagggtggggtgcagcccagccaacagcatgccagggcgcgtcactgcccacgcgatgctggcttcagccgccttcctctcacctcatggccctgccagccgtgcttgcctcctgctgtgtcggggctgggagactttagcctttctccagatgttttcaggagtgcggtggggaaatgaaggccacatgctgtctctctaaacaggattaatgttcagaagcccagcgggtgccctgacctaaccacgggcctcttgcactccttttctcagcttcccttggcttctgagctacccctctgcagcgttgtttctgagtgtggcatttaggagcaccctgtcgtcttgcctttcgtccctccaagccccgtctgttccttggttggttgtgcagaagagttgctagggtttgaatccaggacggtcctgcccctgtgactcgcgggccatcttctcacctgtttgtctctgtgttcctctctgtaaaagtgggaatcattacagtaccttcctcatagactgctagggtgataaaatggagcgatgtacatgaaacctgaacgcagtgcctggtatgcagtccgtgcttagacagggctctggttttatttttatttctttttctttgagacttggtctcactctgtcacccaggctggagttcattagcataatcacgtctcactgcagcttcccactcctgggctcaagcgatcttaccacctcagcctcccaagtaggtgggattacaggtgtgagccactgtgcctggcaccattcagcaatttttttttgttttgtttttgagacagagcctggctctgtcacccaggctggagtacagtggtgcgatctcagctcactgcagtctctgtctttcaggttcaagtgattctcctgcctcagcctcccaagcagctgggattacaggcgtctgccaccacacccagctaatttttagtagagacagggtttcaccatagtggccaggctggtcttgaactcctgacttcaagtgatccaccctcctcggcctcccaaagtgctgggattacaggcatgagccatcacacccggccatcagcaaatttttaagtatacaatatagtattgtgagctatagacactattctgtacagtagaccgtaggactgactgactcatcttgtatgaccaaaactttatacgctttgaccaacacctccctgtttcccccaccaccagctccttgcaactaccattctgttctctgcttctatgagtttgtcttttttagatgtcacatgtgagtgagatcttgcagtgttcgtcttcctgtgcctggcttatttcatttagcataatgttctccaggcgcatccatgttgttgcaaatggcaggatttctttccttttttttttagacagagtcttgctctgtctcccaggctggagtgcagtggcacgatctcggctcactgcaagctccgcctcctgggttcacgccatcctcctgcctcagcctcccgagtagctggaaccacaggtgcctgccgccacgcccggctaattttttttttttttttttttgcatttttagtagagatggggtttcaccgtgttagccaggttggtctcgacctcctgaccttgtgatccgcctgccttgacctcccaaagcggtgggattacaggtgtgagcgactgcgcccggccaggatttctttcctttttaaggctgagcgatagtccatggcatgtatagatcatgttttctttgtccacttgaccacggatagacatttagttgtctccatcttggttgctgtgagtgacgctccagtgaacacgggagtgcagatatctcttcagggcccatgtgtggctgagattaggagatcactgctgtcgtctctagttcagcagtgctagtgcctcctggcgtttagcgtccagctcaagggagtggaatttgggtgtctcagggtctagggccacctgtgcctctaaatcgcagggaagctttgtgtgtgtgtgtggtggggtgcggggggctatgggtatgtggtggggtgaatcttatttctcttctttcccttttcttaattttccgttggcaaaacagagcgccactccagacccctttcattcttgcaatatacatgaaaagtacagggcttgttctgcaaaagaagagtagccccagcgagctcagggttgagtgaagttccgcaaggatggcacctctcggctcttctgggggcttcaggacagagctcagtgtcgccaagcaggacccccactgcgggcggagctgcagggccatcaacattcattaggtggatcagtgaatgtagactctgcggtgtcacaaagcagcacctgtactcactgtgcctgtctcgggatggaatctaagtcagacatccttgcatccccacttatgggctgttccttcaccttgctggtcctcacctttctcctagagttacggggaggagtaaatgtgctaaggccatacacgccgactctgcagtggccttgaaccatgcttctctgtcacccctttcgttgccttgacaatggctgcagcctcctttcccatctcccctaggatcttctcctagggtctcttaatacaggggtccccaatccccagagcacggactggcaccagttcatgcatgccctgttaggaaccaggccacaggccacacagcaggaggtgagtggcaggcgagcgtgtgagacttcatctgtatttacagccgctccccatcttttgcatcaccgcctgagctctgcctcctgtcagatcacctgtggcattagattctcataggagcgcgaaccctgctgtgaaccgtgtgcgcgagggatccaggctgtgtgcttcttttgagaatgcaatgcctgatgatctatcactgtctcccatcacagctgagatgggaccatctagttgcaggaaaacaaactcagggctcccaccgattctacataatggtgagttgtataattatttcattatatatgacaatgtaatcatagaaataaagtgcacaataaatgtaatgcactcgaatcatcccctaccctgtctgtgaaaaatcgtcttccacaaaacctatccttgctgccaaaaaggggatggctgtctttttttcttttgagatggattcttgctctgttgcccaggctggagtgcagtggcacaatctcggctcactgcagcctctgcctcccaggttccagcgattctcctgcctcagcctcctgggtagctgggattataggcacaatggcaccgtgcctggctaatttttgtatttttagtagagacggggttttaccatgttggccaggctgctctcaaactcctaaccttgggtgatcctcccgcctcggcctcccaaagtgctgggattacaggcgtgagccactgtgcctggccagggaccactgtcttaatatgtgaattaggcgatgccatgaccctgcttaatgcactcccagggcctcctgtgagaattagaacaaaaaatccatgctctgtaccatgcctccaagattggctatgtggtggcctttggtgacttctcccgcccaatcttgggtcctagctcattggtgcagccatatcctccccccaccccaccccactgtggcctttgcctgtgccatctttctgcctggtatgtgcttcccgagatctttgcacagccagctcttcctgacccttccagtctgctaggatgtcatctgcccagaccgccactctggtgcttcctgtcctgacacccctgctctttccttcacagcaggtactgctctttgtcattatgttcttatctgtgagctttcatctttgatggactatgagtcttaagaggacagagatatcgtttctgattttcccccatgcctgtgactagcccaggtctaggcatatagtaggtgctcaataaacagtcatcgaatgatagattgaatgaatgaatgcatgacaggaaccctgcacttatctgtgttaatccgtctcttggctgccgggaacaccagctcctgcaacctggcacttgggtcacctgattgaaccctcctgataactctctaaactctgtaataggtgggttctagaattagtcccatttcacagatgaagaaatcaaggcctggtgaggtgaactgacttgctttagggcagcagggatgatttttgcctctctggagatatttggcaatgtctagagacagttttgattgtcataacttgaggaggtggggagtgctactatcatctagtggcagaggccagcgacgccactcagtatcttacaatgcacaggatggcccccgacaaccaagaattatttgggctcaaataccagcggttctgaggttgaagaagccctgcttgagggcacacatctgtaagtggtggagacgggaacctagacctggaaccttgttttgttaaccactaccctgcactgctcacatgcgggggtgggtgggtgggaagagttgtagaatgtttccatgtctgagtcaaaatcttgcttctctgctctagggagatgaatttggaatctgtgaggcctgaggccattcacttgatctccggccctggagatcttgcctccaagcgacctcaggctccatctgtctgccatgtaccttgcaaacaccttagaattctggctgggcatggtggctcacacctctaatcccggcactctgggaggccgaggcgggcagactgagttcaagaccagcctgggcaacatggtaaaaccctgaatctacaaaagatacaaaaattagccaggcatggtgatgcgtgccaggtagtcccagctacttgggaggctgaggcaggaggattgctggagcccaggagatcgaggctgcagtgagctgtgatggtgccagtgtactcaagcctgggcaacagagtgagaccctgtctcaaaaaacaaaaccagctgaccaaacaaaccaaaaggccttagagttcaagcacgtggtttagaggtggtggatctcagtgtcagactctcagtgggttcaaatcctggccctgtttcttctaggttgacgagcccaagcaatttacataaactctctggacctcagagcccttgccaggaaaggggagagttttaatagtcctgactttgtagggctgttggaaagcttaaatggactgtgcttgggaagcacttaatcactgtgcctggcgtgatcactctggctgttattattggcacccaataaatacatgctttctctttgtttccaactcagcatttagaaatgtcctacccttcaattcctgctgctatttatttatttgaagtgcgaactagctttcttattattattttagaaatcatgcagaggagaaaattcaaacagtacgaaagataatacaacaaaaaatagtagttgccttcctctccctggtttcaggcctaccccctgcagattaattagctttttttctttctttttttcttttcttttttttgcaatatgaagtcttgctctgttgcccaggctggagtgcagtggtgtgattttgactcactgcaacctccgcctcctgggttcaagcaattctcctgcctcagcctccctagtagctgggattagggcagatcatgaggtcagaaatgtgacaacagcctggccaacatggtgaaactccatctgtactaaaaatgcaaaaattagccaggcgtggtagcaggcgtctgtaatcccaggtacttgcgaggctgaggcaggagaattgcttgaactcgggaggtggaggttgcagtgagccgagaccacaccattgcactccagcctgggcaacaagagcgaaactccgtctcaaaaaacaaacgaaacatcaaattcctgactgtgtatgctgcttgcaggttatatatgaccaggcctggttctgtatctgtaaaatgggttacgttatagtacctgagtcctagagttgtgtgtgaggatgaaatgtaatgtgaaacacttagagtggtgcttggctgatgcaactaatgaatcttccctcttactctttctatagacagaagaaggcggcacaggtttcttcattgcttttcgccctttgctgaaatgtcatcttggcccagaggccctttctgtctacctgataaagaactagcacctgcccacccaccattatgcttcacccactttcttcttcttcaagccatttgctcccattgggcatacatagagttgttttttttagctgttggtagttttggccgctttgcataaagtgaaattgtgtgagagtggagactttattttacttccacatgaccttggcccatggtagtagtcgctgataaatgtccactgagcaataagaacccgactgttgcaagttacttatttatttatttttgagacagggtctcagtctttcacctaggctggagttcggtggtgcagtcatagctcactgcagcctcgaactcctgggctcaagggatcctccttcgtcagcctctggagtagctgggactaaaggcaaacgtcatcacatctggctacttttaaatttttttatttgtagaaggtggggagtctcactccattgccacctctggtctcgaactcctgggctcaagtgatcctcctgcctcggtcccccaaagtgttgggattacaggtgtgtaccaccacgcccagctaagtttttttttttttttttttttttttgagatgcagtctcactcttttgtccaggctggagtgcagtggcctgatctcggctcaccacaacctccacctcctgggttcaagcgattctcctgtctcagtctcctgagtagctgggactacaggcgcacgccaccatgcccggctaatttttgtacatttagtagagagagggtttcactatgttggccaggctggtctcgaactcctgacctcatgatccgcccgcctcagcctcccaaagtgctgggattacaggcgtgaacccctccacccggccagctaagtttttaaatttttttgtagagatacagtctcactgtgttgcccaagctgatctgaaattcctggcctcaaactatcctcctgcctctgcctcttcaagtgctgggaaatataggcatgagccactgcacccagctggttgtgagttattgagatggttgaattgggagtggatgctcaggcctcagtggaacttgtggtacacagtatgtcctcattacctcccatcagtggcagttgagattcataatcactttttctgcctgttgtctgccccatcctctctgtggccttccctcctgtcctggagttggctggctgggtccctggcagggctgcatgcgttatccctgcaggcctgcttgccttatccctgcaggccctggtggagcatctgtgcagaacctgtgccatccagatgggagcagtaagggtgtagggcaaagttagtgagctgcccggtgcacgaggacttccatgataatcagggctgaaccaggaaggcaggtcaaggccagggtcatgtacagaaaggaggtcagcaccaggatcttgtatgggaagacttagatcaatgcctagtgccttagtcatcatcattcagcccagaaaacatgacgctatgcaacaggaattttatgaacacacaaaggtcaggggccactcggacttggacggggtccccaactctttgagtgtcagggctgagggcatggagacacaacttgatcaagctggtgaagtgtccagcaaggagaagcctctgttggagggagccgggagctggggaggacatgcgctttctcttttttttttttttttgagacggagtctcgctctatcgcccaggctggagtgcagtggtgcaatctcggctcactgcaacctctgcctcctgggttcaagcgattctcctgtctcagcctctcacgtagccgggactcaggcctgtgccaccacgcctggtgaatttttttgtatttttagtagagacggggtttcaccatgttagccaggatggtcttgatctcctgacctcgtgatccacctgccttggcctctgaaagtgctaggattataggcgtgagccaccgcgcccagccgacttgcgctttctctgtaaagatttctgtgggccaggttccccaaagggcaggccctgggccagtgcagtgaccggtgaccgtgttcaggactcatctcttgtggctgaattgtgtgtctggagagttgggtccttctgattctgctcagagcgtggtgggcctggctggatttccctagattaggaagcagcctcgggtagctgtgattctttgagttgggaacagcaagtggcctgcagactgccagggaatcgtcccttccttgagcctttaggtattgcccattattcaccgtttttcccagaagcctccagtagtgagagtcgcacttcttacctcctggagttgttaaagtaaagaaggacacattagggtccctgccggtaaggaacatccaggaggcctcgataccttttttttttttttttttttttccctgagacagagtctcgctctgtcacccaggctggaggacaatgacctgatctctgctcactgcaacctccacctcctgggtttaagcgattcttgtgcctcagctgcccgactagctgggattacaggcatttgccaccatggctggctaatgtattttttttttctttttcagtagagatggggtttcactatgttggccaggctggtcttgaactcctggcctcaagtgatctgccctcctcagcctcccaaagtgctgggatttcaggtgtgacccactgcgcccagtcccgatactttgtttctttgagacagtctcttactctgtcacccaggctggagtgcctgggtgggacgatcaaagctcactgcagcctcaagcccctaggctcaaaagatcctcccacttcagccttctgagtaggtgggactacaggcctgcactaccacgcctggataatttttaaatttttttggtgaagacagggtcttactttgttgcccaggcttttcttgaactcctgagctcaagcaatcctcccgcctcagcctcccaaagtgctgggtttacaggcgtgagccactgtgcccggtcctcagatgatcttagctttgtgacctatgctgttggccgctgtaggggctgtgatggaggtgatgtgggggtggatggcaggggtgacccgtgttggctgctttctgtaacagtcatagttcatggtcagagtcagatttcctctcgtcatgccttccttcccttccttctgctccctcccacagccgccctttgggtctgggctggccatctggctctgagcaggaagctagcctgtgctcttcaatttgctttctgcaggggaaacaccttcctttgctcagcgtttcctgacctctccttccctggagttccggtgtccttaaatgctctctggtttcttctgtagcttactttcttgcttgaaaggacaacttttctttgtcctttagacttcttatctctgggcaatacagtggtggtggcagtggtgattattatcaactattagtatctgctactacggtttattgtctctagactgtatcagcacctgtcacacattgtcccattgaatcctctccagaactcttccaaatgatgtgttttcctgacttttaaaaaaattaaaaaaaaatttttatatttttttgagacggagtctcgctctgtctcccaggctggagtgcagtgctgcgatctcggctcactgcaagctctgccttctgggttcatgccattctcctgcctcaacctcctgagtagctgggactacaggtgcccgccaccacacctggctaatttgttttttaatatttttagtagagacagggtttcaccgtgttagccaggatggtctccatctcctaacctcatgattctcccaccttggcctcccgaagtgctgggtttacaggcgtgagccactgtgcccagccaaaaaaatttttttaaagaaatggggtctcgctgggtgcgatggctcacgcctgtagtcccagcactttgggaggctgaggtgggcggatcacctgaggttgggagttccaggacagcctgaccaacatggagaaaccccatctctactaaaaatacgagattagccaggcgtggtggcaggcgcctatagtcccagctactcgggaagctgaggcaggagactcgtttgaacccgggaggcagagattgcggtgagctgaaatctctccattgcactccagcctgggcaacaagagtgaaactccgtctcaaaagaaaaaaaaaatagaaaaagaaaaataaaagaaatggggtctcactgtgttgcccaggctggtctagaattcctgggctccagctgtcctcccatttcggtctcccaaattgctgggattaaatgtgtgagcctctgtgcccggcctctttctctctctctctctctctctctctctctctctctctctcctctctctctctctctctctctctgtctctttctttctttctttctttctttctttctttctttcagcctgagtctcgctttgtcgccaggctggagtgcagtggcacgatctgggctcactgcaacctctgcttcccaggttcaagtgattcttctgcctcagcctcccgagtagctgggactacaggtgcatgccaccatgcctggctaatttttgtatttttagtacagacggagtttcaccatattagccaggatggtcttgaactcctgatctcatgatctgcccgcctcggtctcccaaagtgttgggattacaggcgtgagccaccgctcctggccttccttttttttgaagcaggttctcactctgttgcccaggttggagtgcaatggtgtgattatgtctcactgcagtgtctaccttccaaggctcaggtgatctcctgcttcagcccactgagtagctgggattataggcgagttcaccatgcctggctaatttttgtgtttctagtagagacgggtttcaccatgttgtccaggctggttttgaactcctgggctcaagtgatccacccgtgtcggcctcccaaagtgccgggattacaggcatgagccaccgtgtccagcttttctgactctttttacttatcaggagactgaagcttggagaaattaagtgacttgcccaagttcacatggggttaaggcctgaatttgaatctacatctgctcaattaggaagtgagtggtcatagctagtctctacctggatggattgttgtttaattgttaaattttttcaaaataattttaaattattttattaaaaaagagggtatcattatgtttcccaggctggtcttgaactcctgggctcaagtgatcctcctgccttggcctcccaaaatgctgaggttacaagtgcaaactactgtgcctagccagattattacttaacaaccaaaacaaaggaggaaattgacggtggacaagtaagaagatcattgcaaaggttgggggcaggttgtttggggagtgtggaggaagctttttaaatgaggtacctgagttggattttgaaggatgaataggagtttgttaggacagaaagacattgcagagagaggatctagcaagaggtgactgaagaaaccatttatttgaccagcagttggggaatgccttgaaggcaggaaccacagcctttcagaatctccagtgcctgcaacagtgtctagaacattatctgacaacaagcttggtaaatacttctttaagtaaatgcctgagtaaggcacatttggggaacagggtgggagaaattgtaggagaagtagatgggacttgaatgtagaaggaaggcctcatggatcactgcaagggttggttatttttttttattttttatgttttgagatggagtctcgctttgtcgcccaggctggagtgcagtggcgcgatctcggctcactgcaagctctgcctcccgggtgcacgccattctcctgcctcagcctctccaagtagctgggactacaggcgcccgccaccacgcccggctaattttttgtatttttagtagagacggggtttcactgtggtctcgatctgctgacctcgtgatccacccacctcggcctcccaaagtgctgggattacaagcgtgagccaccgcgcccagccagggttggttcttaaaagccaatagggagccatgggaagttgtttcccagcagaagagagaaggccattagatctgccctatttattaatgcaaatatctaagtctatgaatcttcctctgagcaggaaaacgtgattgcttttaaatccatatggaaagaccctcagttttactcatgataaagagaaaaggaacttaaactacacagagatatttttcacttcagattggcagaggtcggaaacttgttatctgctgtgctttgtgaagtaattgcctttgtaccttatcagctggagtatgaattgatgttccctatttggagggcagtgtctgtctaaatgttactgtaggcaccctttgacctggcaggttccttttttgaaagtttatatatatgtgagacagagtctcattatgttgcccagggtggtttcaaactcctgggctcatgggatcctcccacctgggcctcccaaaatgctggagttacagatgggagccaccacacctggcagagaaagtgatcttatcaacactcttgcttgagtgtgaaattcaattgtttattcaatgctgcattgtttgtaagaggaacaccaatgccaagtccccaggagaccgatggaagtcaagttcatccctacaatagaatacaaagcagccgtaacaaagagtgaggaaactgttcatgtatactgcgggatgatctttaaaatctgtggttaagagaaaaaagcaaagtacggaacattatgtaacgtatgcttccttcgatttgataacagaagatgtatatttactttatttttgtataaaatattttctgaaagaagacataagcaacccatgatcattgcctctagagagaggaactgaggggagggccatagggaatggaatgagaagacttgtcccttgtacctctttgttcaaaagaaatatcaagaataaaacacatctatgttactgataaagatagtttccaaaggctgtgtgcggtggttcacacctgtgatcccagcactttgggtggccaaggcgagtggatcgcttgagctcaggactttgagaccagcctgagcaacatggcaaaaccccatttctactaaaaatacaaaattagctgggcatggtggtgtgtgcctgtggtcctagctgctcaggaggctgaggtgggaggattgctggagcctgagaggttgaggctgcagtgagctatgattgcaccactgcattccagcctgggcaacagagtgagaccttgtctcaaaaaaaaaaaaaaaagttcagtttttaatattagctaagtaaaaaaaagcaaggtatagaatggagtatcgtagtgccttttgtggcaacaaaataggtcgtatttggaatatatctggaagaatgtaagatgttagcaatggtagcttgcctgtagggtagcaatggggggctgttaatttggggagaaagacatatttttcactgtatacctttttgagtaatttgaaagagttttagcacacaaatatattacctattaaaaataattacaaagagagggagacatgggtggatgcatggatggatagttggttgggtagatggatacatagacaggtggatggattggttggtggatggatggatgaactgttgggtgggtagatggattgatgggtgaatgaattggtaggtgggtagggtggatggatgaattggtggatgggtaggtggatggatgaatgaactggtgggttgctggatgggtggatgaattggtaggtgggtggatggatggattgatgggtgaatgaattggtaggtgggtagggtggatggatgaattggtggatgggtaggtggatggatgaatgaactggtgggttgctggatgggtggatgaattggtaggtgggtggatggatggatggatgggtgaatgaattggtaggtgggtagggtggatgggtgaattagtggatgggtaggtgcatggatgaatgaattggtgggttggtggatgggtggatgaattggtaggtgggtggatggatggatggatgggtgaatgaattggtaggtgggtagggtggatgggtgaattggtggatgggtaggtggatgtataaatgaattggtgggtgggtggatggatggatgaactggtgggtgggtggatggatggatggatgggtgaatgaattggtaggtgggtagggtggatgggtgaattggtggatgggtaggtggatgtataaatgaattggtgggtgggtggatggatggatgaactggtgggtgggtggatggatggatgggtgaatgaattggtaggtgggtagggtggatgggtgaattggtgaatgggtaggtggatggatgaatgaattggtgggtgggtggatgggtggatgaattggtaggtgggtagctgaatggatgaattggttggggggggtggatggatgaattggtgagtgggtagttgggtggatggatgcattggtgggtgggtggatggatgaattggtggatggatggatggatgggttcatggttgggtgataaatatatccatgggtatacatatggatgtgtacatagataattctctggctatgatagggaggactggctgtggtggggaacactgactgtggtggggagcactggctgtagcggggaggactcagtaggacaaggagaggctggaggcagtgaagacttaggaagcagttgcatagtcctggcaaggaataatttggggctaggatcaggtcaattaaatgtttaacattggaactatgtctcttgtatacataactgcatatgtcaagtcttggtatcgttttctttctagcagggcacattcctttggaatgagcttttactggcaactgctcagaagctgttctgtatataatgaccaccaacagtttaatccttttttcagccatcacctcaggaattaacagtagtatgaaatcaattaaaataatcagtctttgagatgtcatgccttctccacgatcaacttcttctttacaaggctgtgttccaaatacgccaggccaaaaagacgtgaactttgtcctttttagggtttgtgtcttgatgtttcctggctaaatctctttgtatgtgttggccttgtaaggtttactttttttttttttttttttgagatggagactgtgttgcccaggctggagtgcagtggtgcagtctcagctcactgcaacctttgcctcccgggttcaggtgattctcctgcctgagcctccctactagctgggattacagacgtgcactaccctgcccggctaatttttatgtttttagtaaaatataaaaattatgtttttatggggggttcttgccatgttggccgggcttgtctcagactcctgactgcctgcctaggcctcccaaagtgctgggattacaggcatgagccaccgcgcccaacctaataactagatctctttaattattggaacatgtatattttgatcagattgacacttttttttttaagtgaagtgatcttatttccctcatttctcatttttaacttttttttttttttgatatggctttaaagctctgtggagctgtaagggtctgggttccttgacactccatgggggtctcaggtgatcgtgggagggctgttggaatcagagctatttggagggtgcataggccagtaggatgggaaggctgtgggagaagtgggctttttggggaccgcagccaaatggacaactgggcctaatctaaagattggcccctcccagctcctactgatggtcatgtaacaggaatggggcccagcaccaccagattttctgatttttttttttttttttgagacacagtcttgctctgttgccaggctggagtgcagtggcatgatattggctcactgcaacctccgcctcctgggttcaagtgattcccctgcctcagcctcccaagtagctgagactacaggcatgcgccaccatgcctggctagttttttgtactttagtagagatgaggttttaccatgttggccaggatggtcttgatctcctgacctcgtgatcctcctgcctcggcctcccaaagtgctgggatgacaggcgtgagccactgcgcccagaagattttctgatttttaaagttatgccagagaccgggcgtggtggctcacgcctgtcattccaacactttgggagactgaggttggcagatcacctgaggtttaggacttcgagactagactggccaatatggtaaaaccttgtctttactaaaaattcaaaaaaaattagccaagcggggtgaccgcagtcccagctatttaggaggttgaggcaggagaatcacttgaacccgggaagcagagattgcagtgagccgagatcgcttgaacccgagaagcagagattgcagtgagctgagatcatgccactgcattccagtctgggtgacaaagcaagactctgtcaagaaaaaaaaaaataaaaataaaaagccggaaatcaaattttaaatgttgggatctaatctaatttttttaaaaacaaaaagtatgcctaaaacaacagcaataacaacaagccatctatgggccaaactgtgggtggggaaacctattttgtacttcttattttatccgattgaattgtggtggagataggaaattgagaccccaaaaagggtagtaagttttcccaaagttatttagtcagttgccagattatggcttgaattaaatttaaattcttcagctgggcatggtggtgcacacctgtagtatagctgcttgggaggcagaggtgggaggactgcttgagcccaaaagttcaaggcacaggaagctgtgatcttaccaccacacttcagcctgggcaacagagcaagacctcatttcaaaaaaagaaaaaaaaaagaaaaatttaaattcttcattacagaacagctgatggtggaggtttattcttgggcaggtacatctgatctatttatgtatgtatctatgaatttgtctatttggcatggctctttagcaaaatacaggctttttttttttaagtaaaagtaattgaaacaaaatttgtttccaaggctggacagctcagtggcaaaatgcagacttgaacaacattgcccgagtttgaattcagctccagagcttaccagctgtgtgatactggacacagtatttaacccttctgtgcctgagtttcacatctgaaaaaggagatgataaaaataattacagaatgaaaggagataatacacatgaggtacttagaataaagcctggcatacagaactgcagtttggttgttatccgtggtggtggcggtggcggtggcggtggcggtggcggtgatggtggtggtgatggtggcgatggtgatgatgatggtggtgatggtggtgatggtgttggcagtgatattggtggtggtgatggtcatagtggggaaggtgatgatgatgaatgaagatgattagaaagtcctcagttcacaaggtcagagtgatctagatgacacagggctcttcggttataagagaatatccttcagggttcctttaaatggctctctccatctttcgtactacagtgggacttgccacaggttctggggactgttaatgtgagatgagatgctacatacctttttgttgttggtgggtttttttgtgtgtatgcactgttgtgtgtgtgtgtgtgtgtgtgtgtgtgtgagagacagggtctcgctctgttgcccagggtgtagtacagtggcatgatctcagctcgttgcaacttccgccttccaggctcaggcactcctcccacttcagccgcctgagtggctgggaatacaggcacgctccatgctcagccactttttgtgtttttcatagaggcagcatctcactatcttgcctaggctggtctcgaactcccagcctaaagtggtctgcccacttggcctcccaaagtgctgggattacaggcatgagccactgcacctgacctgtatgctcctgttaagagagctttatttttatttatttattttgagacagggtctctgttgctcaggtgggagtgcagaagacaccacatacctttatcccttgttcctcatttcttagtctttctggctactgatctttttagtttgcgtgttcatcctgaaaggtccttggatatataggagccttgtctgtttcttcaaaccccgtggcagctggtttcatgctccaggcgagctcctgtcctctggggtgtgtcctgctgacccctcgcctgtgtttgtgttcgcaggactggaatgtcacgtggaataccagcaaccccgacttcaccaagtgctttcagaacacggtcctcgtgtgggtgccttgtttttacctctgggcctgtttccccttctacttcctctatctctcccgacatgaccgaggctacattcagatgacacctctcaacaaaaccaaaactgtaagtcactggggggtttcgttgtggggggtgggaaggtgcacctggacggggagtggtggttggtgataactgacatttctcttctacttagttgaccctaagttccttcttctagaaggcagaagaataatgtgggaggtgaaaactggagctctggagacaaacatgggtacaaatctttgctctgccgcttagtatttggcctcgagcaaattttttaacctccccaagcctcagtttccctgtttatgcaataggaatgataggcttgttctcaaggcattcctgggagattatcagctcttcccctcttactgagccgatctcctttttatttaattaaatatatttatatagattttttctggccaatttttaatttattttttgtagagaggggggacttgctgtgttgcccgggctggtcttgaacacctggcctcaagcagtcctcctgccttggtctcccaaagtactgggatgctcagtgtgaaccaccacgcctggcccctaattttttttttaagttggcttttattttgaaataatttaaagctacaggaaaattgcaataatgggccaggcgtggtggctcacgcctgtaatcccagcactttgggaggccaaggcgggcaggtcaggagtttgagaccagcctgaccaacatggtgaacctgtctctactaaaaatacaaaaatgagctgggtgtggtggcatgtgcctgtaatcttagcaacttgggaggctgaggtgggaggatcccttgaacccaggaggcagaggttgcagtgaactgagatagtgccactgcactctagcctgtgcaacagagcgagactccttctcaaaaaaaaaaaaaaaaaaaaaaagttgcgatgataccaggaactgctgcctgattttctctatccatcactcatagtcactgtttcctgttttttttttttttgttgttgttttttgtttttttttgacacaaggtgttgctcttttgcccaggctggagtgcaatggtatgatcacagcatactgcaaccttgaactcctggctcaagccatcctcctgcctcagctttttgagtagctggtagctgggactgcaggcatacaccaccatgcctggctaatttaaaacaattttttgtagagacagggtctcgccttgttgcccaggctgttgtcaaactcctggcttccagtgatcctcctgcctcggcctcccaaagtgctggtattacaggcatgaatctggcctgtattcactgattttttaatcttttgctacatttgttttatcatgagcttttgttctctctctctgtatgcatgctataatttattttttctgaatcatttgagaatggatgcaccttgaaacatatcccacccgtagagggctctcagtaaatactggttgaatgaatggttgtcgtggagggctttcttgtgcagtgcgccggagttgcagctagagatgagctgtgagctgagctcttgagtgttcaggcaccggggagcatggtgaccagacaaacagtcctgttggaggtagtggggcgtagcaggctgattacagaccatcacgtgccggcctggatgccagctcaccataccgaggacttgtccttattccagtggatatgtgccatgtcctaggactgtggctgatcatttgaaggctggctggttctcctatccctggggctgagctgttcgtgcaggccctgggggaggttccagggcggtctgttgtaggatatgtatgtgcttctcttccaggccttgggatttttgctgtggatcgtctgctgggcagacctcttctactctttctgggaaagaagtcggggcatattcctggccccagtgtttctggtcagcccaactctcttgggcatcaccatggtaagtaggagctggctgtgacccctgggccatctgctgggctcagtggagaccaaaagtaataactcgtaagactagaatcatagttttttaaggcaatgatcagctggagctgggatataaattaaatgtagcctttttttttttttttttttttttaaagacatgagatctcgctttcatccaggctggagtgctatggtaccatcatagttcactgcagcctcaaacttctggcctcaagcaatcctcctacctcagacttctgagtagttgggactacaggtgtgtgtcaccacgcccagcttatttttggctaattttaaatttttctgtagaaatgggatctcactgtgttgtctaggctggtcttagactcctggcctcaagtgatccttccagagcactggcattataagcatgagccactgttcccagccccagctgcagtctttggatggggcatgtgttgtccagtttgccacagtccccaccatgccctattgtcttccctgccactgattgagtggcagatgcccccttttgttgcgtttgccacactttgctcttgcattggctactttggtcacttatatactaactgcctggggtctaatggccttgagttttcactatctggcatagggggtgggttgctaagctaaataggaaactgctctgtcccgggggatacacaacttagtgagtgacagagacaaggaaacaactttattaattacagctggtgtgtattgagcacttactatgtatgtacctggcagtattcttggtgtttcacgtgtcttgaaattcattgaattttcacaacaaccctgtgagatgggtcctgctttgttcccatcttacaggtgaggaaaccaggcaagagaggttaagtgtcctgctcaagatcacaccactaatgtgcagccgagtcaggggtgggaccccagatgccatgcttttagcccctgcaacctgcagcttctgagccctgaacagagagttctcggagagtgtagcccttgagtattgtaaaaagaggagggaggctgggcatcgtggctcatgcctgtaatcccagcactttgggaggctgaggcgggagaatcacttgaggtcgggaatttgagaccagtatagccaacatggcaaaaccccgtctctactaaaaataaaaaaattagccggcgtggtggcacacgcctgtagtcctagctactcaagaggctgaggcaggagaattgcttgaacccgggaagtggaggctgcagtaagccgagatcgcaccactgtgctccagtctgggggacagagcgagacctcatctcaaaaaagaaaaagaaaaaaaaaaggagagaacaagtttaaggcaggacattctgagcagggtgaacagtgtgtccagggaggggtggaaggttaaggggaggatgcaggcagggaggacaaggtgttcggtgaaggaacacggtgtgaaggttggggggatagagtggatgtgacagaggggtcaggaaagacaacgtggagccaggttgccaaggaccatgaatctttatttttctaaattaatttttcattttttaaattttagagtcagagtcatactctgttgcccaggctggacttcactggcgtgagatcacagctcactgcaggcttgaactcctgggctcaaatgatccttctgcctcagcctcccaagtagctgggagtgtaggcatgcaccaacatgcccatctacatttattttttatttatttatttttttatttttccccccgagatggagtttcgctttgttgcccaggctgaaatgtaatggtgtgatcttgagttgccgcaacctctgcctcctggattcaagcgattctcctgcctcagcctcccgagaggctgggattacaggcatgcgccaccacgcccggctgattttgtatttttagtagagatgggatttcaccatgttggccaggctggtctcgaactccggacctcaggtgatccacccacctaggccccccaaagtgctgggattacaggcatgagccaccacccccggccagtttgttatttttgtagagacagggtctccctatgttgcccaggctggcctcaaactccttgtctcaagtgatcctcctgtctgggcctcctaaagtgctaggattataggtgtgagccaccatgccctgcccagaccatgattctatatagcacacatatgtgctgtccactctctgccaagaactgtcctaatccctttattaacccttttacgttgtaaataaggtaagcaaagtgtggtacagagaggagaaggactggcccaaggtcacctggtcagtaagtggtagagccagcttccagtctaggccccagcgtgtagcctggcacctgctttacgcctggctctcctgctgggtttgattcccctttgtgtcctcagagcctggccctgtgcctggcatgcagtaagcgttccataaatgcatggagggaatgagagagtaaagggctttgctttgtcctgaattcgggtcttgggctctgtgttctggcagtggggtattagagtggatttttttttttttttttcaatttcactataatagagacagggtctttccatgttgcccaggctagtcttaaactcccgagcccaagtgatccctctgccttggcctcctaaagtggtgggattacaggcatgagccaccatacgtggtcagctgtttttgacttgagtaggtcatcctcccttaacattccttgttcctggtcttttttttttttcctttgaggcagagtttcgctcttttttcccaggcgcaatggcatgatcttggctcactgcaacctctgcctcccgggttcaagtgattctcctgcctcagcttccccaataactgggattacaggcacgcgccaccacacctggctaatttttgtatttttagtagagatggggtttcaccatgttggccaggctggtctcaaactcctggcctcaggtgatccacgtgccttggcctcccaaagtgctggtattacaggcgtgagcaactgtgcctggccgttcctggtcttttgatcgttcatttatgcctctgtcaccctgggggaaacaggggtgatagtctgagggttggggcttttgactcctcaggggactctgagctgggctggccaagaggtgaactggcctgtgagatcctcagcctctctttatctacctgagatctctgggatggaatggaggaccaccagctcagctgtgaatgtgtcagaaacattctgactatatcccagggaaccaggatatgcaggcactggtaatatgggacaggatgcagccagcacatgttttttttttttttctttgagatagcgtctcactctgtcgcccaggctggaatgcagtggcatgatctcagctcagtgtagcctccgcctcccaggttcaagtgattctcctgcctcagcttcccagctagctgtgactaaaggcgtatgccaccacgcctggctaatttttgtatttttagtagagatagggtttcaccatgttggccaggctggtctcaaactcctgacctgcccgccttggcctcccaaagtgctgggattacaggcatgagccactgcacctggctgatttttttttttttatccctactctgtatcaagcgttggagacacaaccatatagtctagctgtgcaaacagacattaaacaaatgattcctcaaaaggcacaaagtgtttgaacgtctgcagagtgctgtgtgagggtgaaggcaggggagcttggtttggtctggggcatagccaggcttctctgagggagggatggtggaggtgaagcctgagaatgagcaagttgttaaaaagcttaaggggctgagggcagaggaccagctgcggagaaaagcacatgtaaagtcctgagggtcacagggaaaacttgagagttgtgtgtggctggagcagagatggccgaggcagagagcaggggcgatggggcagaggctgaccccgggaacgttgagcatcagggcaagtgggttttgttttctgtactgggttctctgcctgttcttttaaataaagttttattggcatgaaggcatgtccattcattaacatcttgtctatggccactttcacactgcagtggcaaagctgagtagttttgatgtagtctatggcccatgaagtccaaaatatttattacgtggtccattaagaaatagtgtggctgggagcagtggctcacacctgtaatcccagcaccttgggaggccaaggcaagtggatcacctgaggtcaggagtttgagaccagcctggccaacgtggtgaaaccccgtctttactaaaaatacaaaaattagctaggcatggtggcgggcacctgtagtcccagctacttgggaagctgaggcaggagaatcacttgaacctgggaggcggaggttgcaagtgagctgagattgcaccactgcgctccagcctgggtgacaagagtgaaactctgtctcaaaaaaaaacccaacaactcctgtcttgtgcttctctcctcagctgcttgctacctttttaattcagctggagaggaggaagggagttcagtcttcagggatcatgctcactttctggctggtagccctagtgtgtgccctagccatcctgagatccaaaattatgacagccttaaaagaggtaagtggcagtctccttcctcatcttccttcagtggacccggagggagagatgctgggtccctctggcttgtgtagaagtcatgcgttgccatgggaaccaggggctgggtaccacatgcacctagcttctcccttggtgactttcctaccccaccaaatcctcactaaatcagccccagccttttttctagcacctcctttccccagggcctgatttgtctgtgttgctccaaggggctcccatgggacctccaagggcaggagctgtgggccgatgccaggctggccccatcagcaggaaacagcaagacaggcggctccaaattttgccaggctgggatggagccgagccgggaacggtgtttgcagagtgactgttcccctgggggaccctaggcttgtcctcgcgttacctttgtcccatcagttgctgctctggctggggaagttgtttacattggctgctgtgtgctgctgctaggaattttgaggagtgtgcacttttttttttttttttttgctgttgttgaggcggagtctcgctctgtcaccaggctggagtgcagtggcacgatctaggctcactgtaacttctacctcctatgttcaagcgattctcctgcctcagcctccccagtagctgggaccacaggcacgcgccaccatgcccagctaatttttgtatttttagtagagacggggtttcaccacgttggccaggatggtgtcgatcacttgacttcgtgatccacccgcctcggcctcccaaagtgttgggattacaggcgtgagccaccacgcctgacctggagtgtgtgcttttggaataacctgctgttcctgccatcttggagctaattagagactggcatgaggcaaaggaaggaaaagaagctgaacatttgactattgattgcctacatattattatgagtgatagcagctgatgctgattgagttcatgttttcaaagtgcctcgcaggggactgtgtatgtgtcacgaataatcttcctgacctcttgcagtgacttggacagaatttctcagcctcagcactaatcgacattttggattggagactcgttggttgtaggggctgtcctgtgctttgtagacatttaggggtgtccctggcttcccctgactgggtgccataacactcccaagttaccacaaagaagatatccccagacactgccagatgtttcctgggaggcagaatcacccctggttaagaaccaccggtggtttataggtggggaatctgaggcacagaaaggttaaataagttgacaagatcccacagccagtgtgagagagccaggccttgatacagctctgtttcactcccaagccctgtcttcctcccatcaggcagcggtgagcagtgagactacccgtgatggagccggctttctgccattacatcccggggggagctgggagcccctggggagcctgcagtgtccctgtggctgagtgggtttctgccacctgctctcagaatgtgatcttggttttttttttttttttttttttgagatggagttttgctctgtcacacaggctggaatgcagtggcgtgatctcggctcactgcagcctccgcctcctgggttcaagtgattctcctgtctcagcctcccgagtagctgggattacagttgcccaccaccacgtctggccaatttttgtatttttagtagagacggggtttcaccatgttgaccaggatggtctccaactcttgacctcaggtgttctgcctgtctcggcctccaaaagtgctaggattacaggcgtgagccaccacacccagccccagaatgtgatctttttcttccttccttccccaccatgtaggatgcccaggtggacctgtttcgtgacatcactttctacgtctacttttccctcttactcattcagctcgtcttgtcctgtttctcagatcgctcacccctgttctcggaaaccatccacgaccctgtaagtgtgaccacagatgagtgtgtgtgcgtgtgtgtgtgagagagatgcgtgacacagtaccagctaacatttcttagatccatccaggatctcgttccagcctccctcaacccctgatacagggaatatcatcccacctactttacagatggaaaaactgaggcttagatgtggctgggggagctgaaggagagaatctgctttgtcattgatgaactgctgtcttgcaggcctgtaggtttctcacttggcatggtgattttggaaaatgtgagcagataattacaaatcaggtattttttatgaattctagctgtccagatgttctggaaaagtaaagttctgacagattaggcctataatcctacagggcagagctgaggagttgctggagtccccggcactccctgttgtattatactggcatgctttcctcacttgtggcaaatgcctggcccctgagggatttgagtgtgagatccttggtctattttgtcagtttcagagaaattctgtaaatatggaaacttatcagtgaggagtgtagagatggccaccgtttctgctagtagaacaaaagggaacactttattaatttcccttaattcttttcttcttttttttgagacagggttttgctctgttgcctaggctggagtgcagtggtgtgatctcggctcactgtagtcttgacctcctgggctcaagcaatcttcctacctcagctttctgagtagctggaattacaggcacacaccaccatgcctggctaattttttttctttcttcaacttttattttaagttccagggtataggtacaggatgtgcaagttcgttacataggtagatgtgtgccatggtgatttgctgcacagatcaacccatcatctaggaatcaagcccaggatccattagctattcctcctgatgttctccctacacctgctccccaacttggcttacttttaattaattaataattaaagatggggagatggtctcaaacccctgggctcaagcgatcctcttgccttggcctctcaaagtgctgggattacaggtgtgagtcaccacgcctcgcctattctttatttttttaaatagagatgggatcttgctgtgttgcccaggctcatgtgcagcttttgataagagagatctgggaaggcctgcccagaaaactgcatgtgagcggagacctagaggggtgaggtagtgggtggagcaaacacctagaggaagagtgttccaggcagaggggaataagtacaagggccctggggtggggaggtgtggagagaacagcaagaaaagccagcacagcaggagaaggctaagagacagtgggtgcctgagaggtgggacagcccccttgtgagccagatgagctgtttgggttttattgtgagtatggggcagggaggccttggagcacctatttgatgctgattcatggctagtcagctggtaatgggcggattgcagtgggagaacttttcacctctgtggttctgttgggtttggcctaaacctctgtgaggggcagaggctcaccttgtgggtgacgaaagggcttggtgggcatcagtatggaggaggaggttgatgataactaagagattttagaaacctatgtctcaggccaggtgtggtggctcacacctgtaatcgcagcactttgggaagctgaggcaggcagatcagttgagttcaggagttcgagaccagcccagccaacatggtgaaatgccatctctgctaaaaatacaaaaattagccaggcatggtggtgcatgcttgtaatcccagctagtcgggaggctgaggcaggagaatctcttgaccctgggaggcggaggttgcagtgagcagagatcacaccactgcgctccaacctgggtgacagaatgagactctgtctcaaaaaaagaaaaaagaaatgcatgtcccagtgtatgttctgaggagtcccgtgttggtatttccttgcccaaagaggagctgggttggagaaatgagcaagtgcacacatctgtgtatgtattcctgtgcatctgtgtgtacgtgtgcatgtgcctgcttgtgtgtctcggtagtcataggcatgtatatgcgtgtatgtgcttatatgtgaatgtgtgcttgtgagtgtgtttatgttcatgtatgtgtgtgtttgtgtgtgtgtgtgtctttgtgttgtgtgtgcttgcatatgtataaagttcacaaaggcaatggtgactcatgcctgtaatcccagcactttgaaaggccaaggctagaggatcgcttgagcccaggggtcaccccattttggatccctggctggtgcctgacacagaagagaggggctcatgagtcagtggctgttatatgtattgtgtatcagtgtgtgtaagtgtgtggcagccgagtgtccctgtttgtcaaatgttgggctattcttttttgtcttttgtttgttgtttttttctgttgttttgttttgtttttagacggattcttgctcttgttgcccaggctagagtgcagtggcatgatctcggcccactgcaaccccgcctcctgggttcaagcgattcttctgcttcagcctcctgagtagctgggattacaggcgcccatcaccatgctcgactaatttttgcatttttagtagagatggggcttcaccatcttggcccggctggtctcgaactcctgacctcaagtgatccacccgcctcggcctcccaaaatgttgggattacaggtgtgagccaccgtgtctggccgagccattctttagaactgggatttatacaaaacaagtcacacctcaactgggtggctgcagaccttggattgctcagggtaaacagagtctggttggggctgcctggctggcgtggggatcacccaacccatcaagcttcctctgggagcctgggaagagctctcttgccatggatggttctggaagctttttgaaggagggactttcttaatttctgatctcccttgggaatctggataaattccctttcacttctcccctgggcgtgtgtgtaccagggtgactcacagatctgacttggacctttttttgtgctttctgcattcctggcagcctgggcctgggatttgctctgccaccctgggtgacatgaagctctcagctctggcggctaaaaggctacactgttgtggggctgggacaccctgactcttctccccagtcattgttttctgtttctgtgtcatctcccccagctcggctcctcctgtgtcactgctggtcttccaagatggtggaagacactgtggtttgtctctttgcagtctcgctctgtcgccaaggctgtagtgcagtggcatgatcttggctctgcagcctctgcctcccaggttcaagcaattctcctgcctcagcctcctgagtaactgggactacaggcgcacaccaccatgcctggctagtttttgtatttttagtagagatggggtttcaccgtgttggccaggatggtctcgatctcctgacttcaagtgatccgcccactttggcctcccaaagtgctgggattacaggcttgagccaccgtgcccggctgtggtctgcctcttgtgcagtgagatccagcagggtgtcaaatgtgggtgtgcaggctgctgcatttctgacatttgtgcacctgtccaggagagaacactttgattggctgacactctctgtccaggaagcctgaacttccctctgggttcctgttcaggaaccccatggggttgccatttacctttttgcagattagagtttagaccaggagttagccagtagcccatgggccgaatctggcctgctgcctgtttttgtaaataaagttttattggaacacagccactcgcgttcatcacatagtgtctacaggtgtctggagctgcagcagtggagttgtgtagttgctacagagactgtagcacccacaaagtctaagatacctaccatctgaccctttacagaagaagtttgtccacccctggtctaagcatttctttagctctgatgactttttagcttccttttttgtcccctttccatttgcaggcattctttcttcctatgcaaggcaaggacgggaatcgacatttattagatgcttgcggtgtactggctagcactatgctaagttctttatatgcatgtctcacttgactctcacagcagtcctggtgaacttggtactatttttctcattttacagacaaacaatcgcagacataagtgccttgctcgacctgagtagtagagcagagattcgaactcacgactggctgttgtgcacaatcatgtcacttcgcttggttgtaactgctgaatgggagggtcttggctaaataatggctttgtgttaggctagaggcttcacgtggcagtatccaccttgtaacctcagtgcctaagacacagccaggcacacggtgggcctgtagtggtaatttattgttgtgttatatggggaggtgctcagtacatgtggcacgtatattatgtcttgcataagggtgaagtgtgcatgaggcctcacaggacatcagattaagctgcttctctgccttcatcctgttcaagtattaccagcaagaaagaggaaggggactgatgtatgcacagatgttctgaaggcttggcatggtgtcaagagccttatttttttttttaatgttgcattttggggggttaaatatatgtaacctaagatttgccattttaaccattttaagtatgcaattcagtgatgctaagtgcttttaaaaatcttgttcaaggccaggtgtggtggcttacacctataaacccagcactttgggaggccgaggcaggtagatcacctgagatcaggagtttgagaccagcctgaccaacatggtgaaatcccatctctactaaaaatacaaaaattagctgggcatggtgttgagcacctgtgatccctgctatttaggaggcagaggcaggagaattgcttgtgcccgggaggcggaggttgcagtgagctgagatcgctccagtctgggcaacagactgagaccctgtctcaaacaaacaacgaacaaatgaacaaacaaacaaacaaaataaccacataactacctagcaacgtagcctagcaattgagatgggggcaaggaagggtaggaaccaggtcctgtgagaatcagctagacttgtggctttgggctcggtgctcttcctttggggacgtcagcagccccttcttgaaaacgggttgcaactcgatttgttgttggcttcacctcctctctctgtcccagacctgagccctgtgatctggggaggaggacaacgggacaacctgtttgcttgttttcccatcactctcagggattgaatcacagtggagccaggaagatggggagagtccaggcttgctgctctcccatcctcagagcagcagcaggccatccatcacctgtcgcctgtcctcagagtgatcagccaaggcctggggcggctggggtcaggtcaggcagggcgtgggtgggagctggcagggctggctcctccaggccacttcgtgctgagtcactgagtcggccaatcctccccagctggccctgctcccactccatgactcagatgtctattccagccctggctgcttggtggggctcctcccatctgtccttctggctctggggctgccgaggcttttgggagcctgggcagggctgaccaagactgccagagctccggccggtccccagtctcctgccttttttctcattggcactgagtctgtggtttaggtttgggggaggagggtcttgtagataaggggatcaaggccaaaggagatcatttattaggtcccagctgaaagcagaggtccttggaccagttggaatgctcgacatcccccggaagcttgctagaaatgctgggtctcaggcctcatcccagacctaccaagtcaaactcattttaacaagatctccaggtggttcagggttgcaaatcactggtttggaacattcagtgaaagctactcagctcgtttgcagtaagaggtatttttagtcctgtctgtataatatgtaatattttccccccagcattttactatgaacattcttaaacctacagaaaagtcgaaagaattctactgtgagcagtcatatagttggtacctagagccacagttaacattttgctaaacttgctttgtcacatatctgtctgtctaaccagatagctaatcagccagccaaccggctacttttgttttgttttttgtttttgagatagggtctcactctgtctcgcagactagagtgcagtggtgtgatcatagctcactgcagcctccaactcctgggctccaatgatcttcccgcttctgcctcccaggtagcttgggccctacaggtgcacactactgtgtttggctaatttttaaattttttgtaggcgtgagggctccttatgttgcccagtctggtcttgaactcctggcctcaagccatcctcccacctcagcctcccaaaatactgggattacaggcctgagccactgaacctagtttttttgatatctgaaacttccttcgaaatatattagtattctttcatgcacccacttccaagtaaatcattagctagagtttaagatctgtttacacttctgagttttttgcttaaaatttacatacagtgaaattgctgatctcaagttagcatttgatgaatcttggtaaaggaatactttaaacccctgtcaagatatagaacactgcaaggacgccaggaagttccctcgtgccccttcatgatcagtctctgtccccacccaccaaggcctgatcttggaccgttgattaaagcgttgaaactccattttctttccatttctccgtcatgctttcagtcatttaataatcaggtgttgtgccaggggctgagctagaaagaaacagaccttgaccactgccctggaggagagatggaaggtgggtggcaggcagttgaaccaacaactgcaggatggacagtgggggctctgagggagggaagtgctgggagttgtgggggctgggagagtggtccctgactcagcctggggctccagggctagcatccagggaggagaggggatgctcaagtctaaggaatgcgaggctctggccaggtgaatatgtttggaggtggtggggtgggagggtgctcctggtagagcaactggcatgtgcaaaggtccagttgagggagcttgtgggtgttgggaatcacttggaattcggcttggctaggctgggtgcagtggctcatgcctgtaatcccagcactttgggaggccgaggcaggcagatcacctgagactaggagctcaagaccagcctggccaacgtggtaaaaccccgtctctactgatcataaaaaaattagctgggtgtggtggtgcatgcctgtaatcccagctactcgggaggctcaggcaggagaattgcttgaacccgggaggcggaggttgcagtgcgccgagatcgcgccactgtactccagtctgggcgacagagcaagactctgtctcaaaagaaagaaagaaaaaaagaattctgcttggctagattggaagggctaggatgtaagcgaaaagagaggcaagagtcagcatcagagatcaagggtgcaattatgtgtcacaataaggacttggaattttttgtttgtttgtttgttttgagatggagtttcactctgtcaccaaggttggagtgcggtggtgccatctcagctcaccgtgccctccacctccggggctcaagcgatcctcccacctcagcctcgcaagtagctgggaccatagttgcgtgccaccacgcccaagtaactttttctgtttttggtagagatggggtttctgtatgttactcaggctggtcttgaactcctgagctcaagtgatgccctgccttggcctcccaaaatgctaggattacagggatgggtgaaccaccacatccagccaggacttggaattttaaccctactgtggtgggagctgaggaaaggtttttcaccagtggaatgacacactcaggttggacaggttgtggaagatcctcaggctcaaaggaagaggatacattggacatgggggtgaggtcggtggcacttaaaaagcctttgcaggcacccaggcaggtagagagggaggctgagccaggatattcccctgtgcccactacagcatcaaaaaccagaaaaagggccaggtgcgtggctcacacctgtagtcttggcattttgggaggcttaggggggaagatttcttgagaccaatctggtcaacatagtgagaccccatctcttgaaacaaaaaaacaaagaaaacagacaagttgatgggcaaagggcatgggcaaagattctggggtgtgctccagtagaggaaacggaggtcctgggcagggaggcattttgcacagttggtaagcaacagggcaaacaaatcaccagtgtttacgttatactggcaaatctcttactgctggacatttaggctccgtctaataataaggataacagctgggtgcactgtattatttatttagtcctcacagtagggcaggatgatcagtctccccacttgacagatgaagacactgagggtcagagtggtgatgtgtcaggaaccctcccactgggttctcacgcttgaaacacagattgctggtccccacccacacagtttctgatgcagtaggtctgggtggggcccgagcatctgcggttcccaacaagttcccaggtgccaccgatgctggtgacagagctgcgtttgaggatcactgctctaaacattattgctgctgcacgcattgcctcctgctgggtgcaggggttgtggggggcactttggcagtgcagagcggaggtaaccagcagaaaacccgttagaactaaaagctgagagtgtttctgacaaacaggtcaacatgctgaaagacccagacaaggtccttaaactaccctgcgctccaagaatcagtgcctggggctgccgtacctaattggttcaaaccacagggtttctggccagctcatctggtaccaaacgtagatgtcaatatggtggatgccaaagaacacatcactctgtttggatgaatcaggcttttcctccctctgccttcagccaggacttctctgaattgttttcatttcaaatgaaagagggaccagttcacaagctgctttcatgctatctgggacaggagttactgtatttcagtgtctgaggctgggaaaccccctggaggtggctctgtcttttgtacctagtgtgtgatgtcaaaagattctccttggtttgggttaaatgacatgctccctggattacaatccagtgccccatgattttttttcctccttttttattgtcaatccttgacctacttcagaagttagttgtctttgttgtcaagtaaggccttccacgtcagatagaggctgtttccaggccgggtgcagtggctcatgcctgtaatcccagcactttgggaggccgaggtgggtggatcgcttgaggtcaggagtttgagaccagcctggccaacatgataaaacccccgtctgtactacaaatgcaaaaattagccaggcatggtggtgtgcaccatgtaatccccgctatgtggcaggatgaggcaggagaactgtttcaatttgggaagcggaggctgcagtgagctgagaacgcaccattgcgctgcagcctgggcgatgagagtgaaaccgtctcaaaaaaaaaaaaaaaaaaaaaaaggctatttcctttttttttttttttttttttttgccagtgaaggggggaccctgtgttggcctccctatcggtcacttgagataatctgaaaatctgtgtttagatccatagaagagaggcggcctgaggagaagaatttgacaaagctctttgagtgtgcaaattagaaatggcaattgctgggcgcggtgggtcatgcctgtaatcccagcgctttgtgaggccgagataggcggatcagttgaggtcaggagttcgagaccagcctagccaacatggtgaaaccccatctctatcaaaaaatccaaaaattagccaggtgtggtggcagatgcctataatcccagctactcaggaggctgaggcaggagaattgcttgaacctgggaggtggaggttgcagtgagccgagatcgggccactgcactccagcctgggcgacagagtgagactcagtctcaaaacacaaaaaacaaaaaactgtgcagtgttctgtctgtcaatgtccttgttgcatttgcagggcaggttttctaccagtggctggggacttagttttactgggccgagggaaggttaggatttgagggtcttgttaagctggatatgggctgcatttcaagcctcccctggctgtctctatcctgcgtgttgatgccaaggctgaagaagactggatttgcaggcaaaagactgtcatttgaggcctgttttcaccccttaatcactgtgtcttggtatgttgtgggggttgaggtaggcagaggttagccaaccttttctggaaagggctggctgataaatacttgaggctttgcatcccatacactgtctgtggcaacccctaactccgctgtgtagctcaaaagctgccatactcatttataatacataaatgaatgggtgtgactgttccaatgaaactttatttataaatagctggtctgtgggccatagatgcttctgatatataaagcatctggtatagtggtgtattgtgaacccactggggttttttcccccccaaacacttgagctttattgatgtatattgacaaataaaaatggtatataggttgggcacggtggttcatgcctataatcccaggactttgggaggccgaggcaggtggatcacttgagctcaggagttcgagactagctcaaggaatagagtgaaattctgtctctacaaaaaatacaaaaattagctgggtgttgtggtgtgcgtctgtagtcccagctacctggggggctgaggtgggaggatcacttgaacctgggaggtcgaggctgcaaagagctatgattacactaccgtgctccagcctgggtgacagagcgagaccctgtctcgaaaatatatttaaggtgtacagttttatgtttccatataccagaggctactgtcactgcttctattattattactactactactactcatgttaccctttctttggctgttactttgtgccaggtactattctaagtacttaccatgtttgatctcatttaatcttcaccaccaaggaactgacccaaggtcccacagctaggaaatggcaagctgggattgagccgtgccagctagccccgtgctatgcactgcttcacacagaagctgcccctccacccctgccgccttccttttcctttgttcctttgttatcagctggccgtttccagaaacggttggttaacctctgcctacctcaaccctcagtgattaaggggtgatatcgggcctcaaatgactgacctttttcctttgttgcagctctcactgattgtaattctgattgtaattatatatttgtttgcaccgtggtttacttactgtccatcttccccagggcaggaggctgaatggggcaggggtctcgctgtctcgtttgcagctccgtccgcggcacttcacccacatcctggcctataagcaagtcctgcccatatatttgaccaataaataaatgaatcattgacagccgtgccccaccccttcctcctctctctgccagccagcaccttggtctttcacagtgggtagagggcttgggctgcaggtgaaatggatttgcaattccctgataacccacccgccgactgtgggagtgggcaggaaggtgtcagctcttccggatgaaaaaccagcctgcaatgcagtgtttctacccagcctacaaagcaaacaccactacctccacgccttaggttggagaaattccgctttacgacacagtcccatgggcctcatgtcatttgtccctcctggcagtcccgggggataggtcgagcaagcagtaggacaaacgactcccattttccaggtgtaaaaactgaggcttggaggtgaagggacttgcccaaggtcatcagctagaatatagcagggctgggattagaacccaggtctgtccgggtccacggtctgatctgaactcggcttcagttggtctggaatgcaccggctgcatctgatgatcttattaaagatctgtggctgtcagggtcctccccctggaggtgctgatttagttggtctgggttggggccctaggcacttggcacttaacaaactccttaggtgattccagtggacaggcagggctgggaacttcatcacccctccgagccccagagcggagcctgatccttagccctggctgtgtatttgaatcactggaggagctttttatttagccttttatgatggaaacataaagtagacagcctaggataatgaactaccatgagctctttttcttttctttttatttatttttgagacagggtctcactattacccaggctggagtgcgatggcacaatctcagcttgctgcaacctctgcctcccgggttcaagccattctcgtgcctcagcctcttgagtagctgggactacaggcacgtgccaccatgtccggccaatttttatattttttgtagagacagggtcttgccatgttgcccagactggtctcgaactcctgaactcaaagcagttctcccgcctcagcctcccaaagtgttggggttacaagtgtgagccactgcgcccagctgccatgagctctttaccatgcattgcataggtgaacgttttaatatgtatctctgaaggacatggatttgtttattttaaatgactttttatttcgcaatagtttggctcacaaaaagttgcaaaaataacagagttcctgttgttcattgctcaactttctctaatgataacatctgaaagataagaattttaaaaactgtaactgttgggctgcatgtgatggctcatgcctgtaattccagcactttgggaagctgaggcaggaggatcacttaagcccaggagtttgagaccagcctgatcaatataggtagaccttgtcttgacaaaaaacatgtatatgtgactgtaatactaactttaataataattcattattatcaaatattccagtaatccattgtgtttgtacaatggctcattcttctatgatatcattctttatgttttagctgggatttttttatggaaaagagtttccccttcatttctttgatcactgatcactctgtggtgatcgaataaatgactgttttcctcagggaagccttctccaaccctggtgaaccaaatgagtacatttgggaaaggtggagaaaatacttgtttctttccgctttttctgcgttcaaacaatgacctggttcactgacaacatcagatgtttctctttatttccagcgtcaatatgaaatttgtgtacataaacatgtaaggctgggcgcagtggctcaagcctgtaatcccaccactttgggaagccacggtgggcagatcacttgagtcaggagttcgagaccagcctgttcaccaacatggtgaaaccccatctctactaaagatacaaacattagcccagtgtggtggctgatgcttgtaatcccagctacttaggaggccgaggcgggaggatcacttgaacccaggaggcggagtttgcagtgagccaagatcacgccactggactccagcctgggcgacagagcaagactccatctcaaaaaacaaaacaaaacaaaaaccttgcttggtatgtttcagcctgttgtacttattctccttgtcaaagctcaaattgtccctcttttagcctgcagcggccacttctgcttggctcttgagccttttaacaatcctgttcatgcttagtttccttgttgtccggtgtgacaagatgttcttggcttaccttgcatatttcctgcccagccacttttccaagaaaaatctggaagtttaaaacaaaaacaaagcttcagtgccccagtcgcacccagaaccagcttaatcagattgcctggtgcgggtagggcccggatacagtatttttttaaattttatttttattttgtttgagacagggtccctaggctggagtgtagtggcacgatctcagcttactgcaacctccgcctcatggattcaagcaattctgcctcagcctcccgagtagctgagcttgcaggcacccaccaccacatccagctaattttttgtatttttggtagagacgaggtttcatcatgttgcctaggctggtctcgaactcctgaccacaagtgatctgcccgccttggcctcccaaagtactgggattacaggcatgagccaccacacccagccaggatacagtattttttaaaaagcacgcccagccttgaatggaaaaccactggacgagagtatgccaccttatcgggctctgtaaatgccttatatctgcacaaggctggaactttgagtggagtccttggctaaagctttcattactgcctggtgacctctcttccctctgctgctaaagcttgtgtttcagaatttagacccggatgcatccatgttgaaagccaggctttgtctgtcatcccaggagctctgtatcggtccctttccttgcctgcatgttgttgacttggggctcatcttcatttctctgggaaatgagttctttgatagcttgcttagaatctctcagtacttcccattgcccttagaatgaagaccaaaatatgtggcctgcagtgtagactgtgcacagcctccagtgtagactactcaggccccttcttggttcctggagtctaccatgctttcttctaccaccgggcctttgcacacactgctgtctgttgggaatgcgttgcctttccttgttacttagttctcatctactcacccttcaggtgccagcttgactgtctgcctcgggggcgccttctctgaccttcgtacaccagatcagcccccatgcacttactttgtctcattggtaatatttctctcccttcaggacacacatcaaggcccagaagttgtagttttgcatttgttcatgtgatcatttgatgcatgtctctctctggagcctgactctttggggctcacatcctcactccaccgcttttagctgtgggaccttgaacaaatcttttcatctctggtccccagtttttaagttaaattaaattttattttatttttattttgagacactcttgctctgttgccaggctgtagtgcagtcgttcgatcatggctcactgcaacctccgcctcctgggttcaagcgattctcttgcctcagcctcccaagtagctggaactacaggcgcctgccaccacatccagctaatttttgtatttttaggagagacagggtttcaccatgttggctaggatggtctcgatctcttgacctcatgatctgcctgcctcggtctccgaaagtgctgggattacaggcccagtttcttttaactgcaaaacagggatgatataatacttttatttatcttgtgaggtgaggatgaagattaaataaggtagtttgtgtaaagcacttagaaaagagctagctactaatagtagagaatcttggcaggtattactgatgattactgcagtagaccacaagctccatacaggcaggggtcatttctgtttgtttagatttgtatgcagggtgcttggcacaagggttgtgctcaggaaatacttgttggatgaacgaatgaatgaagtggagataatagtaataccatgtttatagaattccatgaggatataaaataatgcaagtatataagctcttggtagagtgtctagcacatagtagatggtcaataaatattcagtgactgaatgagtaaagtggggacaatagtaatacccgctcatgaggttgtcgtggggatataaggcaaccctgtagtaccttgtagaatgcctagcacatagtaggtgctcagaaaatatttgttgaatgaatgagtgaagtagggatgacgttaacaccaactcctagggttgttgtggggatagaagacaaggcaggtctatagcatgttgtattgtggttgcacatggtagacactccgttgattgaaactggaagagctgccatgaatttctttctcctggctattaggagagggtccttttggggtgcagaatggtgtggagctgacgctagtcctctggaaggaagagtgagcagctgactacttgctaagctctgacctggatgaaaagtcaaatcattcctttccctcttcctcccaaacctgtgctttctttccactagaatccctgcccagagtccagcgcttccttcctgtcgaggatcaccttctggtggatcacagggtaaggccaggccccccagacctcagggaggtggtggggagtgaatgaatgaatgaatgaacgaatgaacatgctcagctccccctccccaacttctccctcctttgctcttctgcagagttgtcttgaatctgcctgtgctggccatgtggtctcagagacaccaactctgtccggcagttccgtgaacttgaatgtgataaacacgtgagccgtgagcagctgacacctctgcagaaggctttgcctgggacagccatatgctggactgcttttgctttagcttcagatttgggtttttaaaatattaggtatagttattattgacattgtccccctcctgtcccccacgccttagaaaaataatactgtctcaccacaggaagtgtgggttaaaaaaccacatgtgcagatcagcagtgcaggagacatctagaggtaaccagtgtcaccattttagtatgccttcttctggtcgtctttcttttttttttgagacggagtcttactctgtcagtctcagctcactacaagtctccgcctcccaggttcaagcgattctcctgcctcagcctcccaggtagctgggattacaggcttgcgccaccatgcccggctactttttgtatttttagtagagacagagttttgccatgttggccaggcttgtcttgaaactcctgacctcaggtgatccacccgcatcgacttcccaaagtgctgggattacaggtgtgagccaccatgcccagctaccttctggtcctctttttgtatatctttttctgcccgttgttaacatcttagtggggattgtttgaagaatctttttttgcccctaataagcatcatcttttttttttttttttttttttgagacaggctttcgctctgtcgctgaggctggagtgcagcggcacacttgtagctcactgcagtcccaatctactgggcttaggtgatgctcctgcctcagcctcctgagtagctggggctacaggcacactcccccatgcccagcagatttttgtactttctgtagagatggggtttcatcatgttgcccaggctggtctccagcttctgagctcaagtgattctcccgcctcagcctccagagtgctgggattacaggcgtgaaccaccatgcccggtctcatccttgtcttaatgacaaacatcgttttaaaaaattagatgttttaaataatttcttcaagttactattaaaaagcatcactgggacagttgatgtaatttgttcatgactacaggaccccggatgcatgctaataacattcattcttgttttggaaaattgtgctctagttacataagagcatgtcctggattggaagagaatacctccagtttttcttgggtaaaggcatgtagaggctgtatgttaactttttttttttttttttttttttttgagatggagtcttgctctgtcatccagggtgcagtgcagtggcaggacctcagctctctgcaacctctgcttcctgggttcaagagattctcctgtctcagcctcctgagtagctgggattacagggacctgccaccacatccagctaatttttgtatttttagtagagatggagtttcactgtgttgtccaggctggtctcaaactcctgacttcaggtgatccacccacgtcagcctcccaaggtgctgagattacaggtgtgagccaccatgccagccctttaactgtttaagtggttcagaaaaagatgatgtgtttgcatgtgtgtgtgtgtttgtgtgtgcatgtcaatggatacagacagagaatgatactgcaaacgtggcaacgtgttaacaatggtgagttgagtgaattcttagtatgatttgagtaatttttctataagtttgaaattattttagaacaaaacatgaaagtattttaccttttattataaaagtgtttagtctgctgggcacggtggctcatgcctgtaatgttagcactttcagaggccaaggtgggtggatcacctgaggtcaggagttcgagaccagcctggcctacatggtgaaaccctgtctccactaacaatacaaaaattagccgggcagcacacgcctgtaatcccagctacttgggagggtgaggcaggagaattgctagaatacaggaggcagaggttgcagtgcactgagatggcgccattacactccagcctggatggagtgacatagaaagattaatataataaaactcaataatctcatcacccagatttcatgcttactaatgctttgtcatgtcagcctttttattttttaattttttccttcagcctatttttttttttttctttttatagggtctgactctgttgcccaggctggagtgcagtgacacaatgacggctctttgcagcctccacctcctggccttgagcaatcctgccacctcagcctcccgagtagctgggactacaggtgcgagccatcatgactggctaatttttttatttttacttttcgtagagatagtctccctatgttgtccaggctggtcttgaactccagggctcacaaaatcctcccacctcggcctcccagagcgctaggattatagacatgagctaccgtgcctggcccatatcagccttttttaatttaaaattttaaaaagttggcggggcacggtggcttatgcctataattccaagacttcgggaggccaaggtgggagggttgcttgagcccgggggttcaagaccagcttgggcaacatagggagactcttgtctctacaaaaataaaaaataaaaaaaaaattagccagtcataatggcttacacccaaagtcccagctactcgggaggttgagatgggagaaccactctagaccgggagctggaggctgcagggagctgcgatcgcaccactgtactccatcctgggtgacacagcgagaccctctctccaagtaaataaatgaatgaacgaataataaaaaataaaaaagagctatcctgatacttcgctcctaaatcatctttttttccctaagtcttttgtatgcaccactaaaaaaaaaaaaagccatttttcctgcatgacccaacagaatgagctgtaattagcttgtaatatatgcaaatgtccatctgcattctgacttcccaagctgcatggctgccttcatttgcagcgggcagctgtgctgcagaggggagcagcatcagcaggcgtgtggagtgagtgagccccgtcctccccctcctcctgtcattgactctcattgcctaacccccttgtgtcttggccccaggttgattgtccggggctaccgccagcccctggagggcagtgacctctggtccttaaacaaggaggacacgtcggaacaagtcgtgcctgttttggtaaagaactggaagaaggaatgcgccaagactaggaagtaagtgtgagtttccttgtcctccaggatgccctggtcacctcctttccactcctgtggcctcaatccaggatggggccctggcagtgctgcctgttactagctttgtggttctgggcaagatgcctcacttctcctcctggcctcagtttgcttttctgccaaatggggtaggatctcacatgtcattaaagcaactgggcagagaaaagaagaaagaagctgggtgcggtggctctcgtgtctaatcccagcactttgggaggccaaggcaggcggatcacttggtcgggagtttgagaccagcctggccaacatggtgaaaccctgtctctactaaaaatacaaaaattagctaggcatggtggcaggcgcctgtaatcatagctactcaggaggctgacaggagaatcacttgaacccaggaggcggaggttgcagtgagctgagattgtgccactgcatactagcctgggagacagagtgagactccgtctcaaaaaaaaaaaaagaagaaaaatgttgtccaaacaggcagttgatgctgtctgccatggcgcgtgactatccctccttgagtcagtctcacttttttctgtctctttctgagcatctggcatcctgcatgttcttgctgtttgaatgttctgtccaacatgcccagctgaccacgtaagtctgtttagccaaagaagccccatttgagggtgattttggctgtactggattttaggctctaccccctatgtaaggcgtgccccactgcaccacctctgtcactcttcgggaatcaggccagtgcctcccctgcacataccttaactcatcaaatctgagacaccattagttgcgtgatgcgttattattctatgtaacagtaagaaagaaaagcagctgccaattaaacaaggacataagacttgtctcgagcccggacgaactggaacatgaaattgtgggtgacatgggggcagtggattgcggccatgggggtagtagaatggctgtttttgttcctgttgcctgttctggggtaagtttactacgataaactgtggtggggccagtgtggtgcattggattccccacagacccattggccttacagggaaaaaccccagaccggggttctgttcctcattctattccggggatgcccaggatacaggccttcagtcagacccagatggtgggtgggaatctggacatccatgtgccagccactaggacatcagcagaggacctcgtgactccggtcggaggctgtttgggtggtccaggtgatgggagaaattgtctcgtgggaggcagatagagcttgggcctctgtgactgagcattgtaaggaaatggcccatgtccatgacccagttgaaggtttttggcaggcaaaggtggggtccctgtttattacagttcttcatggagacagaactagtaggatggatggatggatggatagatgatagatagatggatgatagattgatagatgataggtagatgatagacggatagttggtggatgtatacatggtaggtagatggatagatgatagatagatggatgattgatagatgatggatggatggatggatggaggatgagaggggatctactagggaaactggatcatgtgattatggaggctgagaagtcccaccctaggtcatctgcaacctggagaacccaggaagctggtagcatggctcaggcctagtccaaaagtctcagacccagggaagctgatggtggaattctcagtccatagtcaaaggcctgagaacctggagtcattgggtaagtcccagaggccagaaatcctggagttctgatgttcaagggtgggagaggatgacatcctggctgcagaagagagagtgcctgcatttgccattactctgactttttgttgtgtccggaccctctgctgattgggcggtgccacccacatggggcgaggatggatcttccttagtcagtccactcattcaaatgccagtctcgtctggaaacatcctcacagacacacccagaaataacactttaacagcaatctgggtatcccttaacccagtcaacttgacccctaacatcacccatctcatctggattccttcagcctcacctgcagcatcccccccgctaagcaggccacatttgtagtgtgggcttcagcattcctcatcatccacgcctctgctgatcacctggctcggcttcctctcatggaagacggatgcccacctttgtgtcccctggagcttgtcaggagagcaggttgctggagacaccatgggagaggccaatatcacagccttgggaggaggacagagtttgaatccagaagctcctccactggcctggctcttaatccactgagcagatgaaactgactgctgcttttgtgcttagcgacgtttagtccctgagggttcagagagtggaacaaaagagacacactctagttgggtgccatcgacattctatatgggagacaggacgttggttgtgaaacatgcattgacaagaagctttggagaatgatggtgttggggtgagataaaaatgaggaaatgagggtgagagtaaccgaggaagcttttgtgtgtgtgtgtgtgtgtgtgtgtatgtatgtgtgtgtgtgtgtgtgtgtgttttctttttttttttttttttttgagatggagtctcattctgttacccagggtggaatacagtagtgtgatctcggctcactgcaacctctgcctctcgggttcaagcaattcttctgccccggtctcccaaagtgctgggattacaggtgcatgccaccacgcctgactaattttttgtatttttagtagagacggggtttcaccatgttggccaggctggtcttaaacttctaatctcaagtgatcctcctgccttggcctcccaaagtgctgggattacaggcatgagctactgtgtccggctgagagaggtgttttagatacagtggtcaaaggttctacccagtgtggccatgacccttggtgagcatgtgcctgtccctccctaagtctatctctggctgttttcgagcctctggcatcctgagtgttactgctttttgaagtgtttttgttcaacatgcccagctgaccatgtatgattgttttgagaaggtcacatttgagcagagacttgcattggagggagtgagccttgtgtgtatctggggaaggaagggctttccaggtagagggagcagccagtgcaaaggctctgaggacactcgtggtgcatcagggggcttgtgtggcttgaggaaagtgagtgagggggagaaagggaggagatgaagcaggagaaggatttgcaggggtctcctctgagagttaaggtgggattccaggtgcagtgagaacacaggcgcaggttttctgcagggcagtggtgtgacgtgagttctgttgtttgtttgtttgtttgtatgtatgtatgtatgtatgtatgtatgtatgtatgtatgtattttagagacagggtcttgctctgttgctcaggctggatggcagtggcatgataacagctcattgcagcctggaaattccgggctcaagcagtcctcccacctcatcctcccagagtagctgggattacaggtgcacaccaccatgcctggctgatgaattaattaattaattttatattttatatttgtttttttgagatggaattttgctcttgttgcttaggctggagtgcagtggtgctgtcttggctcactgcaacctccaccccccgggttcaagcgattttcctgcctcagcctccggagtagctgggattacaggaatgtaccaccatgcccggctaattgtgtatttttagtagagatggggtttctccatgttggtcagtctagtgtcaaactcctgacatcaggtgatctgcctgcctcggcctcccaaagtgctgggattacaggtgtgagccactgcgcctggcctttttaaatttattttattttattattattatactttaagttttagggtacatgtgcacaatgtgcaggttagttacatatgtatagagacaggtctcactgtgttgcccaggctggtctccaagtcttggcttcaagcagtcctcctgcctcagcctcccaaatagctgggattacaggtgtgagccaccacacccagctgagttctggttcataacaacccaggctgtcctggggaaggtggatatttagggacaagagtgaaggcagggagaccagggtgggaacctcaagggctgtccatgaagtcccttcatgcctcaccgggagccgccattgtatttatttatttattttttgagacagggtgtcactcttttgtccaggctggagtgcagtggcacgatctcggctcactgcaacctccatctcctaggctggagtgatcctcccacctcagcttccctagtagctgggactacaggcacgtgccaccacacctggctaattttttttttttttttttgtagagatgatatctcgccatgttgcccaggctgttctcaagctcctgagctcaagcagtccacctaccttggtctcccaaagtgctggtattacaggcgtgagccactgtgcctgactggagcctccatttttcacccagagcattttctgagaattcagtgagatatatgatatgataagctgtgccctagccctgagtacatgctgggcaggttttaattgtacaagttttatttattcatctgtacactttgatcttgccagggaggatgtggtgagaactgggtcttggggcttgaaagcgggccacctgagaagggtctggctctgtgagtaccttggtgtttagagatcctcagcgtggagccaggggatcatttacttgggacattggtagacggatcgcttgctttattcccagaggcataagccagatctggcacctgtaacccctgtgaacctggagagagtgagaaggaaaaccctgtcctaggctggaatttcctggtgtggccccttacactcagatcccttttgttaaccagagaaaggaatgcagctcgtgcagctctgggctgctgggtatcctaggctcggggatcaggtgatggacgccagggctgggggctctgcatggcttcctggatccttttaccacctctcttcacccatgagtgactccttctcaaaagtcaggtgtggctgggcatggtggctcatgcctgtaattgcagtacgttgggaggctgaggcgggaggctcacctgagttcatgagttcgagaccagcctggccaacatggtgaatccctgtctctgctaaaaatacaaaaattagccgggtgtggtggcgctcacctgtaatccagctacaggggggctgaagcatgagaattgcttgaattgtttggatttaaaaacccagtgcttcattggtttgtgtgtagtggttttatgttctcttttgtgtatggccactcagagcttagggccattttggactgtggtttctgctggcatgaatgtgaaatgcttctgtgactctggaagagtttggcagttttttttttttttttttttaagttagacacagtgaacataccaccagtcacccccttcccaggcatccagccaacagagctgagaacatatgttcataaaaggctggtacaggaatgttcttagctactttgtgataacccaaactggaggtaagccagacatctattagcaagtgaacagacagatgcaccagttatgtacatctgcacaactgaatactaagtgatgtacaagaacgaactattggccgggcacagtggctcatgcccataatctcagcactttgggggcccaaggcaggcagatcacttgaggtcaggagttcaagaccagcttggctaacatggtgaaaccctgtctctactaaaaacataaaaattagctgggtgtggtagcgcacacctgtaatcccagctactcgggaggctgaggcaggagaatcgcttgaacgcaggaggcggaggttgcagggagtcaggatcgcaccattgcactccagcctgtgtgatagagcaagactccatctcaaaaaaaaaaaaaaaaatccctataagataaagactacttttttggtgacagctttattgagatattcatacaccgcacaattcatgtatgcagaacatacaattcactgatttttagtgtgttcacagagttgtgcagtcatcatcacagtcaattttatttatttgctttttaagacagagtcttgctgtggcgctgaggctggagtgcagtggcacaacctcggctcattgcaaccccctcctcctcctgagttcaagcgattctcctttctcaccctcccaagtagctgggattacaggcaaccgccaccatgcctggctaattttttatatttttagtagagacaaggttttgccatgttggtcagggtgttctcaaactcctgacctcaagtgatccacccgcctcgacctcccgaagtgctggcattacaggcatgaaccactgcacccagtcaaaaaaaaaatttttttttagaaatagggtcttgctgtgttgctctggctggctggactgtttttttttttttttttttttccactgatgtatatatgcctatccctttacctgtcttgatgattgttgttcttttttttgttttgtttttttctttttgagactgagtctttttgcccaggctggagtgcaatggtgtggtctcagctcaccacaacctccgcctcctgggtttaagcgattctcctgcctcagcctcccaagtagctgggattataggtatgtgccaccatgccgggctgattttgtatttttagtagagatgaggtttctccatgtttggtcaggctggtcttgaacctgccgacctcaggtgatctgcccacctcggcctcccatagtgctgggattacaggcgtgagccactgcgcccagcctattgttgttctttctttttgagatggagttttgctctgtcacccaggctggagtgcaatggcctgatctccactcacagcaacctccacctcccaggttcaagtaattctcctgcctcagcctcccaagtagctgggattacaggcacctgccatcatgcccggctaatttttgtatttttagtagagatggggtttcactatgttggtcaggctggtctcaaactcctgaccccaagtgatccagccaccttggcctcccaaagtgctgggattacaggtgtgaaccaccactcctggccatgattgttattttgtattgttttgaaatcaggaagtgtgaatcctccaacttgattcttatttttcatgattgttttgactgttctggatccttgagtttccatgtgaattttaaagttagctcataatttctacctggcagccagctgggcttttgatggggattgccttgactctagatcagtttggagccatcagttttctaagtctttaacttattcaactcgtttaatcttacctaccttggaggtaggtcctacttttatcctcatttcacagaggaggaaactgaggcccagagagcttaaggaccttgtctgaagtcacgcagctggccagtggccaagccagaccttgagccggtggctctggagcccgtggctctggagcccgtgtttgtaaccactgtgctgagctgcctctttccctgggcttgttgtctttgactctgccttccctgaagggtgacattccctggccatgtccctgtggtagggggctgcatctctggcagaccccacaacggcttcacctccttgtgttccaggcagccggtgaaggttgtgtactcctccaaggatcctgcccagccgaaagagagttccaaggtggatgcgaatgaggaggtggaggctttgatcgtcaagtccccacagaaggagtggaacccctctctgtttaaggtgttatacaagacctttgggccctacttcctcatgagcttcttcttcaaggccatccacgacctgatgatgttttccgggccgcagatcttaaagtaagaccccttccctcccaggtgggctccattttccctccttggctttgatctttcagttgcatcagtcataaccctggggtcatgctgtgtcctgaagtgggctcatagccagatgtctccatttttactttagcttttttgaaaaaaatagagacagggtcttgctttgttggtcaggctggtctcgagctcctgacttcaagcgatcctcctgcctcggcctcccaaagtgctgggattgcagatgtgagccatggtcactgcctagctttactttatgctttacttaattaccatattagtgaagaccacatcgtttgcaagtaacagaaacccactaggctcccctaaaacccaaatggggaggatatggcattgtcttgggaaaccaagagcaaggaaatgccagcagatctcatgaaaaaactgcaaccagggttgggcgcagtggctcatgcctataatcccagcactttgagaggctgaggtgggaagatcacctgaggtcaggaggtcaagaccagcctggccagcatggtaaaaccatctgctaaaaatacaaaaattagccgggcgtggtggtgcacgcctgtaatcccagctactcaggaggctgaggcataaaaattgcttgaacccaggaggcagaggttacagcaagctgattgcatcactgaactcaaaccttggcgacagagcaagactttgtctcaaaaaaaaaaaaaaaaaaaaaaagaataaaaacaacaacaaaaaactgcaaccaggaactggggagtcagaaaggaagttgcctctctcctacctggctctctgctgctctgtgactcaggggctacacatcccttctcttttcctccctacctctttacctcgtgttccctatgcaattcctttgggtgacttgctggtgatgagatatagctagagcaattagtgcacaaccccaaggcagaggcctcttttatgagcagtttgggtcacctgcacagccagatcaccactgtggacttgtttttccatctatgaaattgaagtgatagtgtctagctcatctggctcaggagaaagttgcagtgccaacactgaagctctcttccctgcccccacgtgtcacaagtcattccaggccctctctttgctcctttgcaggttgctcatcaagttcgtgaatgacacgaaggccccagactggcagggctacttctacaccgtgctgctgtttgtcactgcctgcctgcagaccctcgtgctgcaccagtacttccacatctgcttcgtcagtggcatgaggatcaagaccgctgtcattggggctgtctatcggaaggtaggggacgctgtgccattggcatgtggcccgacttccacatcccctcctgcagccctgggttactctggggccagcgtggggatttccagcccagcttctggagcagtaggatgagggtagcttccgtgaccttaggtggcagggacagcacgcatcaggcattgtacgttaggaaagctgatttcaagggtgggcgtgtagatgtctttgtgtatcagctgtgagtaattgagtttcttagatggatcagtggcccttgttgtggggaaatccaagtttggatcctcattctgctgttaacattctgtgtttcagcttgttgtcactctttttttttcgtttttttgagaccaggtctcactctctcccccagactggagtgcagtggcatgatattggctcactgcaacttctgcctcctgagttcaagcgattcttctgcctcagcctcctgagtagcggggactacaggcgcctgccaccacgaccggctaatttttgtatttttagtagagacagggtttcgccatgttggccaggctgatcttgaactgctgacctcaggtgatccgcctgcctcagcctcccaaagtgctgggattacaggcatgagccaccgcgcccagcctgttgtcactcttaatttgaactgagcaggtggcacattccttgcatggtaagagtatgtagcaggcatttgtgtacatccaatttcaaaggacctaaattaccttcttgatccctataaatttttttttttttttgtctcgaggtcaaggaaactgcttggctcctaggttaggaagagacagtcttgcaggtacttgatgaactagaggagtgattctcaggcctgtctgtgaattagactcacctggggagcttaaactgatgcaggccaggcactgtagctcatgcctgtaatcccagcagcttgggagaccaaggtgggggaatcactggaggcttggaagttcaataccagcctggtcaatatagcaagaccctggctctgcagaaaatttaaaaaaattagccaggtatggtggtgcgtacctgtagtcccgtctactcaggagattgagttaaaagaatcacttcagccccggagttggaggctgcagtgagtcctgatagcatccctgcattccggcctgtgtgacagaatgagaccctgtctgaaaaaacaaaaaaacttcctgacacctaggttgcaccagaccagtgaaattgcgattgctgtggtggcacccaggtgtcattgtttttgttttttatttatttttatgttttgagacagggtctcgctctgtcacccaggctagagtgcagtggcatgatcttggctcactgcagcctccacctcctgggctcaaacgatcctgccacctcagcccaccacgtagctgggcccagaggcatgcatcaccacgcctgctaatgtcttagtgtttttaaaactcacgaggtgatagtgtgcaatcatgtttgagggctagggacattttcccccaccagggcacgtttggcaatatctgggggcattttcggttgtcccaactgggggcgagggcatgtagtgggtcgaggccaggtattgctgctaaaactcctacagtgcgcaggacagccccccaaagaattatctggctccagatgtcaagaatgccaaggattagagaccctggcccacaccctcagtccttcagtgggatctgggaccagtagcactgacacagcctggaagcgtagaaatgcagaatcccaggccacaccccagacttgcagaatccaaaacaactccccccaccccccaccactccccccagaaaaacccggccgcatgtgtgcacattaaagcatgcgaagccctggtttcgaggacacctagggtcccttgccaactgatgagttcaaggttgggaggcactgagcaccgcggataagaatgtgggctttgagatgacacaggcgtcctgggcagacagataggtcgggaggggaggaggagagatctgcggcatttctgcccctgagagtctccttcctctccgtgggtctggagggagagtcaggcctcttcagctgccacactcacccaccttccctctcctttgtcccacaggccctggtgatcaccaattcagccagaaaatcctccacggtcggggagattgtcaacctcatgtctgtggacgctcagaggttcatggacttggccacgtacattaacatgatctggtcagcccccctgcaagtcatccttgctctctacctcctgtggctggtgtgtgtttaacgccgtttccctttgcatgcagggagggacttctacgtgtgggcagtgggccgagggagtgggtgttgatggtaatggcatgtagagctccctggcagttccggctgtggttcatattttattttccagcctgttaaccaattcctcagtattttgttcctttcctgaattgtcaggttgatgttctccttggtggcatggcgttttcattttctcttttccttgacagtgtcagtaattaactaccctacaatggacgacacatcatatttctccccttgaatcctcccaaacgctaaccagactcacttattcattagtccctaattatggtggtcaaaattctctcaattgcaagggatataaatctgtcttaaagtagcctaagtggccggttgcagaggctcacgcctgtaatcccagcactttgggaggccgaggcgggcagatcacctgagatcaggagttcgagaccagcctcaacgtggagaaaccccgtctctactaaaaatacaaaatgagctgggcgtggtggtgtatgcctgtaatgccagctacctgggaggctgagacaggagaattgcttgaacctggaaggcggaggttgcggtgagccgagattgggccattgcactccagcctgggcaacaagagtgaaactccaattccaaaaaaaaaaaaaagtagcctaagtaaatagagggaactttggggctgcatgtatctcagaaatctggggactagcttcaggtgtggattgatccaggagatcaagcaatgttgtcagtactcagtttcacccactgccctgttgtcctctgagttaacatcattctcagtggtacttccctacatggctccgtagctttgggctgataacatcctgatagataaaggtgccagagaaaagacaaggcagcatttctctgcacagccagagtcagtctcagagagcactctgattagcctggcttggtcctattcacacccgtgaaccaatcactgtggcccaggaggcagagttctctcattggccagcctgggtcacatgtcctctcccatggcagaagagatgtgattgacagcccttccatgtggagagggagagttcccaaaataaaatgataagcaaagaggctcatagcacaacacatgccttgtgctttgctacctctggatctttgccacgtacctttccttccttcttcctaattgatgaaagcctgctcatcccccaaggctgtaacaaacactacttccattgatttaccctcccttctcaattagatggacttcttcttttgaattttgagtcccaataactttagtataggaactcatctaataatactttctgaaatagttttttttgttttgtttttgttttgacatggagtcgcgctctgttgcccaggctggagtgtggtgtgccatcttggctcgctgcaacctctgcctcccagcttcaagcaattctcctacctcagtctcccgagtagctgggactacaggcttacaccaccacgcccattaaattttcttttttttttgtatttttagtagagacagtgtttgatcatgttggctaggctgatcttgaactcctggcctcaggtgatctaccctctgtggtctcccaaagtgttggaattacaggcgtgagccaccgtgcccagcccactccctgaaatagttttgttttgttttttttgcatgctcagtgtactgcctcctctttgaagggtaacatgttagctacttgcagacatatagcagctgacttttgtgtcttctgtgggtacaaccccagcagggcctgatgcataatgggcacagctcaaattattatctgttattgaaagagaagggctggacgaaatggctcatgcttgtgatctgaacactttgggaggccaaggcgggtggatcatctgaggccaggagagcagcctggccaacatggcaaaaccccgtctctactaaaaatataaacattagtcaggcatggtggtgtatgcctataatctcaactacttgggtggctgaggcaggagaatggcctgaatccgggaggcggaggttgtattgagctgagtttgtaccactgcataccagcttgggcaacagagcgagactctgtctcaaaaaaaagaaaaaggaagaagaaaaaattactggtttatttggctgtagtttggtttttttttgtacatttgtagagcagaaggtgagtaaagtgtttctaataataaaactcagaaaaaacaccagaatttaattgtctaataggctgggtacagatataggtggcatgcgcctgtaatccctgcactttgggaggctgaggtggaaggattgcttgaagccaggagtttgagaccagcctgggcaacatagtgagaccctgtctctacaaaaaaaaaaaaaaaaaaaaaaaattagctgggcatggtggtgcctacctgtggtcccagctaccgtggaggctgaggcaggaggattgcttgagcctaggagtgcagaggctgcagtaagctaggatcacaccactgcactcctacctgggtgacaaggcaagaccctgtctctagaagaaaaaaaaaatctaaataaagtgtcttttcaagcaggtgtcttggggagtccacttttgtaaaagtgctactatgggaaaaatatttttggaacatttgttctagaactgccttcaggattggtttatgaaccgttaagaaaattgtctaacatcacgttttgttttagatggtagttgcttgagctcagcactgttgacacttggggccagacagttctttgttgtgggggctgtcttttttttttgttcttgttattgttttttttgtttttttaagggacagagtcttgctctgttgcccaggctggagtgcagtggtgcgatcatagctcactgcagccttgaattcttggcctcaagcagtcttcccactttgtcatctcatctagctggggactacaggtgcacgccaccatgcctggctaagttatttatttttttgtagaaatgggggtcttgctgtgttgcccaggctggtctcgaacttctaccctcaagctatcttaccactttggcctcccaaagtgatgggattacaggtgtcagtcactgcacctggccacaaggctataagttaatacagcaaaattagcaaggaattaaggcacacatggggcggtgttcaagagaagccaggtgcaggcttccaggagtccccagcagagtcacaggttcactaattctctggcaaccatgatgattatgtgtgtgaaatgttgccaaccagggaagcttggtaggagctcagttcctgggtttgtattaggggcaggtcacataagcagcctttgcttggcacataccaaaagtctagactcccagagggaaagcggtgttcagcataaaccatattgtttgtacaaacagttgaggcacactgagctactctacccaattctgttaatggtggaaaccctgtaagtatgcagacactagccaagggctaaacttgtaagcagccttcaagcaggaaaagcaatcaggtggtcgtgttcacacttttctgcttactaccttattacctttctaaaaatctaagctgggtgtgatggctcgcgcctgtaatcccagctacttgggaggcagaggtgggaaagtcgcttgagcccatgagtttgagaccagcttaggcaacatagtgagaccttgtctctacaaaaaatcaaaaaaatagctgggcatggtggtgtgagtgtagtcacagctacttgggaggctgagttgggaggatcacttgagcccaggagatcgagagcagtttgagtaacatagtgagaccttgtccttacaaaaaaccaaaaaaattagctgggcatggtgatgtgactagtcacagctacttgggaggctgaattgggaggatcgctggagcccaggagttggagaccagcctgggcaatgtagcaagacctaatgcttacctgtagtcccagctactttggaggctgaagtaggaggatcactgatgcaaatagccactgtactgcagcctgggcaacatagcgagacctcatctcctaaaaaaaaaaaaattagaatcctgcagttgtaatttgcaaaactcatgtggccccaagggcttgggagaaaggagcgtggacctgcttattcttcaagggattgggaggacctggagagatgctcaggaatgaaaccacaggctcttaacaccctattgtggggtaaaagtaacacaccttgccctgaacttggtcagcagcatccacgtgggatggatcaaccggggaagctgttacgggccctgttttcttctgtctggtgagtgatgaagagtctcctttccttccttagaatctgggcccttccgtcctggctggagtggcggtgatggtcctcatggtgcccgtcaatgctgtgatggcgatgaagaccaagacgtatcaggtaaggcatgtgtctctgcgggcccccaagccgggccctaggcagaggcctctccatgaggattttagtccagttccttctgctctgtccctggggttctcagccttgcctgccagttggactcacttggggagccttaacaaatgctgatgccccggctgcatatctgggattctgattcacttattgtgggtggggtctggacatcaagatgttttaaagcttcccaggtcattatattgggcagccaagattgagagctcctgacacatggttagaccttgtaggccggtgactggaatcagaaggtctgtgagcctctgagaaagtccttgtttcccacggtcttgtttattatgtgtatgtgtgactcagctttcaagagttgagtacaaattaccccctacttttttcccccttattagctcttaccttataggatacatgctgttaatctctttatttaaattaaaataattaatttctaaaatggggccttgctgtgttgcccaggctggtctcaaactcctgggcttaagtgatcctgttgcctcagcctctcaaagtgttgggattacaggtgtgagccatcatgcccggctttcagctttttatttttggagatattttgtattttaaaaagtttgaatacccaagtaatagagtgatgtttcttattataaaaaagtccaaatcaagccgggctcacccctgtaatttcagcattttgggaggccaaggtgggtggatcgcctgagcttaggagttcaagaccagcctgggaaacatggtgaaacctgtctctaccaaaaatggaaaagttagctgcatgtggtgatgcgtgcctgtagtcccagctacttgggaggctgaagcatgaggatcacctgaacccaggaggtcgaagctgtagtgagccatgattgtgccactgcacaacagagtgagaccctgtctcaaaaaaaaaaaaaaaaaaaaaaaaaaaaaaaaaaaaaaaagtttaaatcgtacaaaagtacataaattaaaaggggatacccccttccctactctctcaaccactgcaaatatatagaagcaaatccttctacaactttctacgtatgtatatacagacctgattaatggtatagtttggtttgtttttatatatgtgggtttttttttttgtttgtggagatggagtctcactttgttgcccaggctagagtgcagtcgtacgatcttggctcactgcaacctctgcctcccgggttcaagtagttctcctgcctcagcctcccgagcagctgggattacaggtgcccaccaccacacccagctaatctttgtatttttagtagagatgaggctttaccacattggccaggctggtcttgaactcctgacctcagatgatccacccgcctcggcctcccaaattgctgggattacaggcatgagccaccatgcctggccattatatatgttttgtgtgtgtgatattattaccatatctgtttttacctaaatgggcccacgtggcagcatgatttttgtcctttagcgccctgctttggggacctctctgtgctgtgccgtatagcttcaattcattcttccaacccggtgccttttggtctataatggagatggtgcagtttatttctttgctcttctgttgatggatatttatggtgtgctgtggaatttcaaatgggagcactaggctgcactgacgataccacagggagatgagtttcaggacatgggcctgttggaaggagaggcctcacgtggtagggttgggtgggatgggtgaggcaggggctttaggattgagtcacccttcagtctcttgatgtgtaggatgccctgagtggcccgactcaacccatttcagtccctggcctccagatcatgtagcttatattcttcccatctgtgacccggggatgactgtagcactaaatgataagagttcttgtgattgttaagtgtctgaatacatgtaaaatgcttagaaaagttgctgggatacacaaaatcctgggtggtagtaaaagtatttaacaactgcactgcacaagtatccactatttggaaccagtgctagccagtacagaaacatttcactattttaacaaccatgggccaggcacaggggctcatgtctgtaatcccagctctttgggagcctgaggcaggaggttggcttgtggccaggagtgcaagaccagcctgagcaacatagcaaggtgccatctctacaagaaatacaaaaatgaactgggtgtggtggcatatgcctgtggtcccagatactaaggaggctgaggtgggaggatcgcttgagcccaggaattcaaggctgcagtgagctatgatcatgccactgcactccagcctggatgccagagtgagatgatgtttccaaaaaaaaagaaaactgggctgacaagaaataagaaaacaggctgggtgcggtggctcacacctgtaatcccagcactctggtaggccgaggttggatcacttgaagtcaggagttcgaaaccagcctggccaacatggtgaagccccgtctctactaaaaatagaaaaattagccaggcgtggtggcaggcgtttatagtcccagctactcaggaggctgaggtaggagaatctctttaacccgggaggcagaggttgcagtgagccaagatcgtgctactgcactccagcctgggcaagagagcgagactccgtcacaaaaaaaaaaagaaaaaatacgaaaacagagaagaaaaacaccaccaccatgtctcctgtgtttgggtcagcagagtagggactgaatcccttcttttctgtacacctgaagggtttttcttgcctctgttcctggattctaaattgagtatgtttctccaatgtctaacctaacgtgatttgaaggggttttttttttcttgatagcggggtcctttggtgtggtcttggggctcaagagtagggctagtagggattacagggtcagctctcccaccctcaggaggcccatttttaatagacggtgaagttgaggcccagtgcggtggctcacacctgtaatcccagcacaggagtttgagaccagcctgggcagcatggtgaaaccccatctctattgaaaagaaaaaaaaaaatcaatataaaaaacatttacatgtcaaagtatataataaagtttatgagaaaaatagctggtgatgttgagtgatgggctgatcccagggtcgccccagatgtgttgactgcccgtctcttccaaggtggcccacatgaagagcaaagacaatcggatcaagctgatgaacgaaattctcaatgggatcaaagtgctaaagctttatgcctgggagctggcattcaaggacaaggtgctggccatcaggcaggaggagctgaaggtgctgaagaagtctgcctacctgtcagccgtgggcaccttcacctgggtctgcacgccctttctggtgagtgaagccacatttttcctggccctcattgtttgatgttttattttctctgcgtacctgaatatttttaaaaggtcactatgttgcccaggtgcagtggctcatgcttggtaatcccagcactctgggaggccaaagcaggtggatcacctgaggtcaggagttcaagaccagcctggccaacatggtgaaacccagtctctactaaaaatacaaaaaaataagccgggtgtggtggcgcatgcctgtagtcccagctactagggaggctgaggcaagagaattacttcaacctgggaggcgacggttggagtgggccaagatcacgccagtgcactccagcctgggcgacagagcaagaccttgtctcaaaaacaaacaaaaaagtcactatgtcagcaaggccttccctgaacacttggtttaaacatttgccatcttctccattctcctttgttttattcacacttagcagcttctagccaacctgtgtaggaaccgttcgttatctatttactgtgatataaggagcttgtgccagaatgtaaaccagtgccccctgcttcctgcattaagatagccttgcaagacaaaaagtgcgagctgagtcgaacggcacgcttggtgccatagttgatctacattgtggtgctgcgtccttattttgtcaccaactggtcacaaagtgtggattgtcagtgtctcataggccacatgtcaagtggcatggtctaaacacactctaaaatttacttattttgggctgggtgcggtggcttgtgcctgtaatcccagccctttgggagtccaaggtgggtagatcacttgaggccaggagctcgagaccagcctggccaacctggtgaaaccctgttactgcttaaaaaaaaaaaaaaaaaagaaagaaaaaaaaagctgggcatggtggtgcatgcctatattcccagctactcaggaggccgagacatgagaatcccttgaacctgggaggctgaggttgcagtgagccgagatcgagccacggcactccagcctgggcaacacagcaagaccctgtctcaaaaaagtaaaaaaaaaaaaaaataagtaaaataaaatgtacttattttattgtctgcttttcccccactaggatgtcagctccagatgggcatttttgtcgtttctcttgactgctgtatcctcagtatataaaacagtgcatagcaggtgctgaacaaatattgtcatccattgtaaaaaaaaaaaaatacagaaagatataaaatgaaaagtatattgtcctctcttccatcagttcctcccttctaaagtgacagtttcgtgtacgcttttagagaaaaatggacaagcatataggtatttaaaaatactttgacagatataaatggaatcatactgtacatagtgttctcttttctttggttaacaatatatagtcttggttcgttcattctggtctacttcattttagttttttggggggttttgttttgaaatggggtctcgctctgtcccccaggctggagtactgtggtgcgatcatagctcactgcagccttgaactcctgggcccaagcaatcctcctgctttagtttcctaagtagctgggactccaggtgcactgctaccactcccagcttgtttcatttgtgttcatgatggatgcttgtctgacgtgcagatgcgccctgctggaattaccctttctcccattccttgcaaaaacaggttgttccctgttttttttgctgttatgatccatgctacactgaaagttctggtacctgtcctggggtatggtaatgggtctatccctgcctagctggctttgaaaagtttaaagacaacagtgcaacttacaatttgcaaagttggccgcaaatcaggagaccatacagagatggactttggaaattccctttttaagcacagttaaaaacagttaatggtgaaggatgacttcagatcatgccccatgtttgttttttctttctgtctttttattaactgtgtcattctttttgtaatgttgtgctcattacaactattccttcttggtcaggttggcaaattatatgtttttctggcaagtttctgtgaagcagagttaaacatgtttatgaatatgaacttttctgttaaactaccatctgcttcatctttgttgagtttcaggtggaatgtctaaggaagctccagctgtttcagcatttgcgaaagcgtgttcatgctcccactgaattttcttagtcttgccttacttctctcagggtctggaactgcaggagagatggtgttcaaattcaagcctgcatcagaatcacctggagagcttgttattatattttattatttattcatttattgagatgaagtcccagtctgtcacccaggttggattgctatggcactatcttggctcactgcaatctctgcctcccgggttcaagcgattcttccacctcagcctctgagtagctgggattacaggcatgcagcaaccatgctcagctaatttttaaaatatctttagtgtagagatggtgtttcaccatgttggccaggctggtctcgaactcctgacctcaggagatctacccgccttggcctccgaaagtgctgggattacaggcatgagccacagtgctggctgttagcttgttactataaaactcagctttctgggccccacccaaattttcagttttagtaggtctggttggggcctgagtatttgctttcctaacatatccctaggtgctgctgcttctggttcaggttgacatgtagagacaccggagtggatcctcactgcctaaagtctggtccgtggaccagcagccatggcatcacctggtgcttgttaacggtgcagaatttcaggcctcagcccagatccactgaaacggaatctgagttgtaactagttctctaggtggtgtgtatgcacattaaatttcgagagagactggcagaaagtaggagtaaagaaactttttctgtaaatactttcggaattccgggccatacagtctctgtcacaaataccagtctcttccagcgtagtgcaaaaacagccttagataatatggaaatcgatgggtgtggctgtgttcctgtaaaaaagtatttagagacaccaaaatttgaattttatagaatttgcatgtgtcatgtaatattgttttgatttttttaacttttaaaaaatatgaaatctggctgggcgcaggggctcatgcctgtaatctcagcactttgggaggccgaggcgggcgggttgcttgaggctagcagattgagaccagcctagccaacgtggtgaaaccccgtctatactaaaaatacaaaaattagctggaagtggtggtgcgcacctgtggtcatagctactcgggaggctgaggcaggaggatcgcttcaacccaggaggcagaagttgcagtgagccaagatcatgccacacactcctggctgggcaacagagtgagaccctttcctgctgctgcccccccaccccctcccagccccccacaaaaaaaaattagccaggtgtggtggagcatgctggtcatccaagctttttgggaggctgaggtacgggaatcgtttgaacccgggaggcggagatcgcagcgagctgaggtcacgccactgcactctaagcctgggcaacagaacaagactctgtctcaaaaaaaataaaaaaaatgaaatcaatgctgagctcatgggccgtatgtaaacaggtgtgggccaaatgtggacctgagccatccttgttggccagcccctggcttagaggactggaatgttcttctgagaatcaggacacctgccacattctactgccagctcacagtgtgaccccaaagctggtcatctcacctcgctggctctagattttgtcacatggaaaatgaaggggttagattccaagcatgtcaaatactgggccctgtcctccttcctcatgcccacagcagacacccacagtcactcatggggttctttcccactgagttatgttcaagcagccctccaggtgactggtgccagtggcctagagttgagcaagaaatgacatcttgttgcccttctgtaactccatgttccctaagatcacttccagctccaatgcccctgcattctgccttgtacattgcattcttcttacactccaataccttgactttaccggggtgcgttgatgaactctctctttttttgttttttttgggactgagtctcactctgtcacccaggctgaagtgcagtggtgccatctcagctcactgcaacctccatctcccagttcaagcaattctcctgcctcagtcccccgactagctgggattacaaacatgcactaccatgccttgttaattttaatatttttagtagagatgggtttttgtcatgttcgccaggctggtctcgaactcctgacctcaagtgatctacctgccttgatctcccaacgtgctgggattacaagcgtgagccaccgcgcctggactctcctttttttttgagaaggagtcttgctctctcgccaggctggagtgcattggcacgatctcagctcactgcaatctctgcctcttgggttcaagcgattctcctgcctcagcctcctgagtagctgggattacaggcgcctactaccatgcccagctaagttttgtatttttagtagagacggggtttcaccagggttcaagcaattctcctgcctcagcgtccgagtagctgggagtacaggcgcacgccaccatgccaagccaattttttgtatttttagtagagatggggtttagccgtgttggccaggctggtctcaaactcctggcctctagtggtccacccacctcggcctcctaaagtgctgggattacaggtgtgagccgccatgcccggtgggtcttactttataaagtaggaagtaatgtatttgcatatggtgaaacataattaaagctgcaccagatggtattcatacagccggacttcgcacgtggccacctcagcctgctgacattcgccaacaggtcatcctttgtccctgtgttgtagggcctggactgcacattgcaggatgtttcccagcatctgtggcctctacctgccagatgctaagtcgtacctctccctcttcttcccagtggtgacaatagaaaatggctccaggcattgcgaagtgtccccttgggggacagaattctcccagttgagaaccacagtcaatagtgaaaggcccaagcccttcctcctaacaccagtcaccttgcttccctctctccatgtttcttgtgtgtttttccagagtccacgtctgtatcactgtaatggtggatacatgtcatacatgtagttatggttacttgattctgtttactttacttttatacaagtgatagtaagagtcatacataaatacatacaaaatggctttttttttctttttttctttttttttttttttttttgagatggggtctcacactgccgcccaagctggagtgcagtgacatgatcttggctcactgcaacctctgcctcccaggctcaagtaatcctccaacctcagcctcccaggcagctgggactacaagcatgcaccaccatgcccagctaatttctgtaattttgcagagacagggtctcactttgttgcccaggatgttttcaaactcctgagctcgagcagtccgcctgcctctgtctcccaaagtgctgggattgtaggtatgagccactgcacctggccttgatggcattttgaaaggtcttgtctcagaggaaaagatacaagccagagggcgctggtgatgaggtttggtctgtgccttgtgtcccgcttaggaggggatgggcagcgtgttctcacagctttttgctctgcacattggattcgttggcaaaacccacagtttccaggctgtcaccaaactttgcttatcacttcctgccctgttccccattaggaaaccacagcagaagatgcttaagagcaggactggcttttcttctcttttttctttctttctttcttttttaaagagacagggtcttgttttgctgtccaggctggagtacagtggcttgatcacagctcactgcaacctccaactcctgagctaaagcgatcctcctgcttcagcctctggagtagctgggattacagatgtgaaatactgagcccggctaccggctttacttaaccttttcttgagctttcttgccatttagtttcccggagtttccagagacagagtttgttgagctgtttggcaagaaacagatgggcctgggtgtcagctggggagaccttgtcctggccgaggcatcgaagcctctgactacattaggataaaatatgtggcctttagttcccctggaaggtgcctgagtgttttttccactggtgtgcattcctgtgcttcaaagacgatgaggtgtttacccagcggtaggtgtgatggaacacagaggccggggaaggccagggatgccatccagggactgatgggactgtttttctggaatggcaaacctggcatttaccacgtccacctaatgcactttcctaaaatagcatcgccaggcagccgtcaatatttaacattttctgtcttggatgatttgtgagcttcttgccttctgtttaccctgaatctccctttgttagaataattcatcattctctatggtaatgatctgtcctgtagttctctgctgatcatatcctagggcccatggagacactgccacgaccatgtcattttatttatttatatatttatacatttctgtatttttgagacggagtctcattctgccgcccaggctggagtgcagtggcacaatcacagctcactgcaacctccacctcccaggttcagctgattctcctgcctcagcctcccgaagagctgggattacaggtgtgcgccaccacacctggctaattttttgtctttttagtagagatggggtttcaccatgttggccaggctggtctcaaactcctgacctcaagtgatccgcccacctcggcctcccaaagtgctgggattgcaggtgtgagctaccatgcccagtcagaccttgtcattttgtgcttgtaccagcaaagcatagggaccttggcaaatagttcatgctctgtaaatgtatgtaggtaaatgaataaatacatgaatgaatgagaggttgaaataaatcatattaattaggaactgtcttgcaaataacagaaacctagcttaaatcaactagagtaagagaagagggggatttttgagtcacaaaactaaaaagtctagaaaaagacttttaagcatgaatggggttccaggcatggctggatctaggagttcccaagataatgttgggaataacaacgtctctgactctcagctctgctttcttgatggtggtttctttattagctggtagtttcctgatcatcctgtcacctcagcaacccctgtgaacagagagtcttactcttttcccctaatatttcctgcaaagctatgggattgagtctcattggttgtggtcgatcacatgcttcttcctgagccagtcactgaggccagggagataggatgcttgggtcagccagggctaggtcatgtctttcagggcttggggccaaggtagggggtgagggaggaggttcatctgtggctgaagctcataggttgacactgggagaagttcagttcccccagagaaaattgcatgttgccataaacagagtaatagatgccaggtaggcaggaagagcaggtaactgcacacagggcatcaggatttttagggagtgggctggagtgtaggggttccattcattggttttccacgtttctcagaaaaggcacctaggggacaggtgctcctcactgtgtatgaagggcttttgcaccctagaccctcgcctattacaaggcgaactccagtctcctgctgcctggagccccagtcattgtgcccgtcctaccagcctcttcggatttccaaacactgcctgcagggaacctgttaaagcctgtgcttccactagactgtgcgtctcagggttgccaagcccacctcagtccccagcgcatgatgggtgctcagttaccacctgaggggtggatggctagatgacctcctccttctggagaagccaggaccatggacctgaaaggggccgcatgatgttgtcctgtcccctctctgtgtgtgccctgtgctgccagcagccggcatcgattggtacttggctcaccaagggggctggtacgttttggtggtgagatgcctgaggcctggtttgcttcactgctgaagagacacctgtgatgtgctcttctgccctcaggcaaattcacctaccccgtccccacccatttatccactcccacccatccattatctatccagcagacattcactgagcaccatgatctgggctctgtcctaggctctgacaatacagcagtgcatactacaggtaataatctccagtcatggaacattcatttttcacggagagaaacagacaaggaaaaataggcacaataaataaatcctagtgctagagaaagccatcctaagtgctatagaaagaaaagagtcagatctttggaataagggcggcttgcagttttaagtagggtggtccaagctcactgagaaggtgacacttgaggaaagacttgatggaggtaaagaggccaaccagggagtagcaagagcatgtgcaaaggccctggggcattactgtgcccattcataggtgggataaccatggaggctgaaacagtgggagtgaggggagagtgacagatgacgccaaatgaggtacagggaagggactttacaaatcagctgggccttgggatctgagtcagcactttgacttctacactgaaaaataggttgactttggagaggtacttttttaaaaattacttgtttagagatgggggcctcactctgttacccaggctggtgcgggggcacagtaatagctcactgcagcctcgacctcctgggctcaaatgattctcctgcctcagcctccctagtagctaggactacaggtgcatgccactatgcttgacttatttattaatattattgttgttttgagacggagtcttgctctgttgcacacgctggggtgcagtggtgcaatcttggctcactgcaacctccacctcccgggttaaagtgattctcctacttcagcctccctagtagctgggactacaggcacatgccaccacacccggctaatttttgtatttttagtagagacagggttttgccctgtcagacaggctggtcttgaactcctgacttcaggagatccacctgccttggcctcccaacatgctgggattacaggcatgagccattgagcccagccacctggcttattttttaaaaaattttgtagagacacagccttgcttttttgccctggctctgctcgaacttctggcctcaagtgatcctccctcctcggccttgcaaagcatttggattacaggcatgggctaccatgccgatcgaaatgtatttttttaacggaggtataattcaccatttaaaagtgtgcaattcagtggtttttttgtgtgatgtgtggtggtgtgaaggtcacccagtgggttttttgtataaatgataatgacaatcaccactaattccaggacgttttcattaccccaaaaggaagccctgtacctgttaccagttgctccccaaatcttccattccattccaggcaaccagtaatctgctttctgtctgtctctgtttatctactgtggacttttcatataaatggaatcaaacaacaggtggccttttctgactgttttctttttttttgagacgaagtgtctcccttgttgcccacctgaagcgcaatggcatgaccttgcctcactacaacgtttgcctcctaggttcaagcgattctcctgcctcagcctactgagtagctgggattataggcatgcaccaccactcctggctaattgtgtatttttagtagagacggagtttctccatgttggtcaggctggtctggaactcccgacctcaagtgatccgcccgcctcagcctcccgaagtgctgggatttcaggtgtgagccaccccgcctggccatctgactggtttcttagcatgatgttttcaaggtttatccatgttttagcatgtataagaatttcactcctttttatggttgagaagtctatcatgtagatacatgtagaccctttcgagtaaagaatatctctgggctgggcatggtggctcatacctgtaatcccagcattttgggaggccgaggcagacggatcacttgaggccaggagctcaagaccagcctgaccaacatggcgaaaccccatctctactaagaaaaatacaaaaagattagctgggcatggtggtgggcgcctataatcccagctacttggagactgaggcatgagaatcgtttgaccttgggaggcagaggttgcggtgaactgcgatcgcaccactgcactccatcttgtgcaaaagaatgagactgtgtctcaaaaaaaaaaaaagtatctttaggtaagatgccagtgttgcgttaccgcttagaagatgggagccaggatgggtgcagtggctcatgtctgtaatcccagcactttaggtggccgaggcaggcagatggcctgagcccaggtgttcgagaacagcctaggaagcatagggagaccctgtctctacaaaaataaaaaaactagccgggcatggtggtatgcgcctgtagtcctagctactcgggaggctgaggtgggaggaatgcttgagcccgggaggtcgaggctgtggtgagccatgattgcaccactgcacccagggatcatgcgtccctgtcgtttcgagcaccttgcctccctcttgacatcggagcctggaaaatttctgtgccatggctcagcgtcatctgtcttgttaatgtcagagccagaacacgaaccagctctggcttcccgtgggaccgggctctcgcttgtgtgaccacgttaatagattccttggaagaatgatctaaggaatttggaccaaatcttccaacaagaaataaaaacagctgccatctgttgagttttactgtgcttgggccctgtgcaaataaacaccctacataagtgccaacagcccttaaaagcctatcatgacttccattttatagatgagaaaataggggcttgcctggagaggtgaaataactcaaccagggtcccacagcggaaatatggcaaagtgtatggtttttatttttaagctgtatgaccttccaggaagtaacaatgaaatggcagtgctgagaccctgaaaatacatgggccgatggccagatggcagggctatttgggtaaagtgggagagacagctcccttgaatggtgagagggaggagtcaggtggccccctggatggaagatggtttcaggcagaggaaacgtcaggggcaaaggcctggcttggggattgtgcttggtgcttttgaggaatactaagaatgcccctctaggacatctctgagaaagttgatgggagaggccggctctttgggctcccggtcgttgatttatccagttcattcccagagtgtttagtgagcacctgccatgtgccagatactgccccaggtttttccacgagctccagcagctggtcagttgtggccacctggggagggcccaagcgcgtctccagggcctgtcactgctcctaggatgatgactctcactcggggcacagcagtcagcactgggcgttctgcttgcaggtggccttgtgcacatttgccgtctacgtgaccattgacgagaacaacatcctggatgcccagacagccttcgtgtctttggccttgttcaacatcctccggtttcccctgaacattctccccatggtcatcagcagcatcgtgcaggtacagggggaagctggggcgacttccgagagggggccttggggttctaggccacgaaagcatggaagtgcccccgagcgcagcctctagatcacactcccggtcgggctccatgaggcccggacaaaggctgccatgctttcgtctggtcatgcctgaaagaaagaaaacacatttgacttcttgacagagaactcgcacttgagtatatgaatcaagtttaatgcagcagggctttcccatgctctggaagaatctttccgaaatactctgttctcttcagcctgttcctccgccattcctatcctttttttaaaaaacgtagctcttgtctgacttgattgattttacaacccactgataggtcttgaccacccacgctttgagaaaccccaaccttacagccgggcgcggcggctcatgcctgtattcccaccattttgggaggctgaggcgggtagatcacctgaggtcaagagttcgagaccagcctggccaacatagtgcaacctcatctctactaaaaatacaaaaattagccaggtgtggtggcgggtccctgtaatcccagctactcggaaggctgaggcaggagaattgcttgagcccaggaggaagaggttgcagtgagccaagatcgtgccattgcattccagtctgggtgacacagcaaaaactccgtctcaaaattaaaaaaaaaaaaaagaaaaaccccaaccttacggccgggcatgatggtacatgcctgtaatcccagcactttgggaggccaaggcaggtggatctcttaagcccaggagtttgagactagcctgggcaatatggtaaaaccctgtatgtaaaaaaaaataaaataaaataaaataaaaataaataaataaataaataaataaataaataaataaataaatatgtttgaaaattagccaggcatggtggtgtgcccctgtactcccagcgactcagaaggctggggtgggaggatcagctgagcttgggaagttgaggctgcagtgagtcatagtctcaccactacactccagcctgggtgaagggagtaagaccctgtttttttttgttttttgtttttattttttagaaacaatgtagaccatgtagaatctctaaaattcctgccattgactgtgtaaggaggggtggctttctgttttgtcacacttgggcactactggaagctcctgtcacttttctgcactgttttcacattctttttccgagcattgcgaacatcccttttgaaaactccattttaactacataggcaaatcaaccgtaaaatttggtagtacaaggctgatagcaggctttgtcaaaaacaaaaaaatccattttattatgaaaaatgtcaagtgtacacagaagtagaatagcttaaagtttgtaaactggcattaaaagaaaaagaaaaagaaaaaaaaagccaagcatgatggctcacacctgcaatcccagcattttgggagaccaaggcagacagatcagctgaggtcaggagttcgagaccagcctggccaacatggggaaaccttgtctctactaaaaatacaaaaattagccagatgtattggttggtgcctgtaatcccagctaatctggaggctgagacacgagaatcgcttgaacctgggaggtggaggttgccgaggttgcagtgagccgagattgtgccactgcactccagcctgggcgactgagtgagactcagtctccaagaaaggaaataatacaacatgaaccccgtgtacacatcactcagattcaacatcggcattttttggctgggcgcagtggctcacgcctgtaatcccagcactgtgggaggctgaggtggtaggattgcttcagcccaggagttcaaaatcagcctgggcaatgagacccttaatctacaaaaaataacaaaatgggtgtggggtgcatgcctgcagtgactacatgggaggctgaggcagaaggatcgcttgagcctaggagtttgaggctgcagtgagttatgtttgcaccactgcactccagcctgggcaacagagcaagactctgtctcaaataaagaaaccaaggttgggcgcagtggctcatgcctgtaatcccagcactctgggaggccgaggtgggcggatcatgaggtcaggagatggagaccatcctggctaacacggtgaaaccctgtctctgctaaaaatataaaaaaattagccaggtgtggtggcaggtgcctgtagtcccagctactcggttggctgaggcaggagaatgttgtgaacccgggaggtggagcttgcagtgagccgagattgcgccactgcactccagcctgggtgacagagcgagactccatctcaaaaacgaacaaaaaaacccaaaacattttgccacagttgatttatctcattctttttcagtatccctcccttgtccctctttcccttcatttgtttttaatgctaaactctgctatctatcccttcattctttcctttctttgccgaataattttaaagcaaatctcagaccccttacattctacccacaaatatttcagcatgcatttcttcctacataatgtaataccatcatcatgtctaagcaaactaacaataagtttttacaataatactcagcccatatccaagttttctggaatatctcagaaatgcctgtcccattgggctgtttgaattggctctgttgcatttgctgttacgtttccagagtcccttttccaccaggcctctgcccttttcttcttttatttttatttttatttatttattttttgaaatggagcctcactctgtcacccaggctggagtgcagtggcatgatcttggctcactgcgacctctgccttcccaggttcaagtgattcttctgcctcagcctcccgagtagctgggattgcaggtgcgtgccaccatgccaggctaattttatgtatttttttttttttttttagctgaggcggggtttcaccatgttggccaggctggtctcaaactcctgacctcaagtgatctgcctgccttggcctcccaaagtgctgggattacaggtttgagctaccgtgcccagccattcgcccattttttctgaaataccttttgtgggcttttaaaacaaagcagaaccaaacctgtttctttttttgttttgtttaattctaaagtatacactggttctaagaaatgtgggaccttcagaaataagggagggtgtgtgcccctccacacctggggaaacccttgaaagttaaccttggttggttttgcaaaaatgctttttaaaaataactctcccctgccattgctctctgtacaggcgagtgtctccctcaaacgcctgaggatctttctctcccatgaggagctggaacctgacagcatcgagcgacggcctgtcaaagacggtgtgtgtgtgttcagtcctggcttctggaagtggccgccttcccatctcccactgggtcctccctacttgcatttctttcccttggctgccctcaggtttgactctgcccagccgcttgtctgcgagaccccgggggacaagggttctgcagagcctgcagaagggaagggaagcctggcctcctgggcttctgtcctgtctcacacttcccaggagggtgaacttgcacttgcatttttgttttcttgctgagggtcagcagctgcttgaggcttccccgtgggagtcactttccaaggctttgaccttgattctattctgggctaaatgaggactctggaggctggccagcctccatcacccacaagctgtgtagacttaggtctgagcctcagttttatctagataagggaaacaaaagtacctttctttggctgagtgttacttggatttttttttttttttgagacagggtctcattccatttcccaggctggagtgcagtggtgcagtcacagctgtcactgcagccttgatttcgtgggctcaggtgatcctctgaccttagcctcccaagtagctagaactacaggcacacacagcaccatacttggataatattttggtatgttttgtagagacagggtttcaccatgttgtccaggccggtctcgaactccttagctcaagcaatccacctgcctcagcctcccaaagtgctgggcttataggcatgagccagttctcctggcctttttttttttttcaatattaaattgttttatttggagagacaaggtcttgctttgttcctcaagttggtcttgagctcctgggctcaaggatccctctgcctcagcctcccaaagtgctgggatgacagatgtgagccactgcacctggccatgcatttttattggcaggtttgtttgttttgtagcttgttaatttatcgtttcccagcccatccccctgagccagggatgttgtttgtaaccatctctctaggcacttaataataaatattaggccgggcacagtggctcacgcctgtaatcccagcactttggggagctgaggcaggtggatcacttgaggtcaggagttcgagatcagcctggccaacaaggtgaaaccccgtctctactgaaaatacaaaaattagctggacatggtgttgggcacctgtaatcccaactactcgggaggctgaggcaggagaatcacttgaacccaggaggcggaggttgcagtgagccaagatcgcgccactgcactccagccagggcaaagagtgagacttcatctcaaaaaaaaaaaaaaaaataataataataaatattaatggcactaagtgcagtgacacgttcacttataaagcctctgtcatgcacatgccattccaaggatgtcaatgtcccaacttgtccattactcaccatggtacccctggaggagggtgatggaaacccccattttccagatgaagaaactggtctctgaaacttgcctgagattgcacagctgatcaaaagaagaaccagcattcacacccacagcccatcggtagagtccatgctcttcctggccatagggtgttgcctcactgagatttactgagcacctactatgtgccaagcattgtgagaagtgctctgtgtgcactgcctcatagacaccccatcacagccctctgaagttgattgcatgattgtcagccttattttacagatgaaaaagtgaggcacaggctgggtgcagtggctcctacctataatcctagtactttgggaggccaaggctggaggattgcttgaggccaggagtttgagaccaccttgggtaatgtagtgagacctcgtctctacaaaaattaaattcaccaggcatggtggtgcacctgtagtcctagttacttgagaggctgaggcaggaggattggctgagcccgggagttcaaggctatagtgagctatgatcatgccactgtactccagcctgggtgtcagagtgagaccctgtctcaaaaaacaaacaaacaaaggcacagagaagttaactaacttgcctgtggctacccaggtacgaagtggtagccccaggattcaaacccatacagtctggctccagagtccaatgtcagaagattgaatgtgtgtaaacgtcggttataccgcgtgagctgtgtctggcacctcgcaggcgctcaggtatctttagtggcacctaaaacgtttgacacgtttgacacagcacctggtgcatagaagatgataaacagatcctgggagttgtcacttctctggtctgagcgagatggtctcagcatcttcagctcagccccctggtgtggggttttttatcctgggcgctactgacatctggagacacattgttctttgtggttggggactgtcctgtgcactgtgggatgttgagcagcaaccctggactctacccattagatacagtagtatccatcccaattttggcaaccaaaaatggctccagacattgccagatgtgccttgagggacacagttacctccagttgagaaccgtggcccaagtggatgctggactcttcctcccaacactcctgggctgtggtcatctggtttctgctgtcccagtgtcccacatcccctcacatcataaggcaatgattccatctactctggggtcaaatttctctgctaaccacaggctgaaatttgaggtggccggcggtgggtggggggtggtttcttggtactgaagttgttcacagctcaatgcaagcatcaggaaacccctaggcccctgggtgccgcccgcaccccagcccctccttcctgccctaatagtggcctcctaggtggttggacttcctggaatgtttagcacgctctagccagtgggggcccccttggctgctcccagctcccaagctaaccgttctctgcaacctctctgtctccagtggcttttcttaaattccttaaatagcaactcccagtttcctcattccacgtccactcgtagaagagctgagggagaaagttaatctaggttaaccagcaccttcctctctctctaggttttttgtttttttgatgcatggaggaagttatttcttcatttgacaacttaaacaaaaaatactcctgtattatctccagatggtcttaaggtggctcataattcagagagctgcttttctgttttttctttttctttttttttttttttttgagacagagtttcactctgttgcccaggctggagtgcaatggcacgatcttggctctctgcgacctctgccttggtttcaagcgattctcatgtctcagactcccgagtagctgggactacaggcatgcgctaccacacctggctaatgtttgtatttttagtagagatggggtttcaccacgttggccaggctggtctcgaactcctgacatcaggtgatctgcccgcctcggtctcccgaagtgttgggattacaggcatgagcccctgcgactggcctgcttttgttttaagtgagagacatgaagtaaaaggaaaataacaggaagaagagtaaaagaagacagaggtgctaggagctttagaagtgtggagctggccgggcatggtgtctcatgcctgtaatcccggcactttggaaggccgaggcaagcagatcacttgaggccaagagttcgagaccaggctgagcaacatgtcaagaccccacctctacaaaaaatacaaaaaaaaaattagctgggtgtgatggtgcacatcctgtagtcccagttgctcaggaggctgaagtgggagaatcgcctgcgcctgggagatggaggttgcagtaggccgagatcgcaccactgcgctccagcctgggtgcagaagccagatcctgtctcaggagaagacagaaacatggaaccagttaacgtgggctttgtctccgacactctccccttccctgtgccctcgtaccacacttcctgttccgtatcctctttttttgagtttatcgtgatggatgttttagaaagatccacctgctgtgatgtgctgtgtgtagagtggtgtggctgggggaggaagacagaggacctggggagaagggtgaacgacctccctttgcacctcaaggagggcccagcggtctgatgctggccaccccagtggagagaggtttgcatgtggacgccagctgtttcccactgaccttggccactgctcggccctcccagctggagctgccccgaacctgcctgagaagggccagggcatcgagagcattgagtaattctcatgcggcccccgcctctgcagtcatctcccaagatgatcgtccagatggcgcaaccccatcttacaaggacaaagctgcttgcagtttccttctgctttctgggtctggggctgcctccagaactgcaggttgagtttcttctttcagaacccgtggctgatgtcaccagataataatgcctagcgccattcgtgccaagcgtctggggttgaaccattcaagcagagaaagagagtgttctgtgcatgtggagtcgcacagctcagcctgtccctgacatgtctctgtgctttgtaggcgggggcacgaacagcatcaccgtgaggaatgccacattcacctgggccaggagcgaccctcccacactgaatgggtaagccgggacgtggacacacgtgatggtgtggagagagccacagggcttttgttaaacgtggattcgaattcccaccgtgctccctctctgtgaccttgaacaactcactttgcctttctaagacttagcttacccatctggacaatgggtgcagatacacctgcttaggctgtcgtgagaagcagacacacatgcctagcacagagggttccctgggattgtaagttacagcagccttggacagctagacttagacaatacaggagattcttggcttgcgtaactgggaagttctactttcaggtgcggtgtgatccagggactctgccgtcagaactttcttcatattttctgtgtttcactttctcctggtctgctttatcctcacgcatcctctccccttgtgatggtaaatggtcccaacagctcccactgtgtatcccactgttaggagaactgcctgcttcttattgacccagattgggtcctgtgccctctgtgaggcaatcgctatgccttcagacactgagtgtgctgattggccagtctcagtcaggggctgtgatgctgctgaactccagtgcccctcagctgcccagctcaccctttcttgccagctttctatctggcaccccacaccctacagtccttacctttccaaagcacatgatgtctaggaaattgaccttatccccaggcaacttgtcaagcacctctcattttgttctgaccagaggccttgatcaacagctttttaggcccccttaaggaatccgcaaaacacaggggtgatgggacccttttagaggtttagctcatgcctgggtagccaaatcactgctgtattttatgatgaaggagagaaactctccagagaaaacaatctgtagaaggcctgcattgaaaattcatgggggtactgcatgcttaggaagttcttccttatgtctaacttaaatcctgcctgcttcaattgtagctgttctgtcttgttgagctgcacaactaatctgtatctgtgtccctttcctgacccagtggttttcctgttcagttaccttccccccatgagcccccagaacctttctctaacccttttctctcatcagcctgtaagaatatttcagtctcacgtggacagtggcaggtactgtctcacgtggacagtggcaggtattgtctcactgggcttcctgcccactcaggccccataatcctttcccctcccagcacaggaacaaaaagcctgatgagtgtcaccatgcagcagtgtcataagaatgaaacaatcagtgacagcaacgactatcagcatttccactaatactctgaaatcagaaaggtggcagttaaaaagcacagaatcccagcactttgggaggccaaggtgggcacatcacctgaagtccgaagtctgagaccagcttggccaacatggtgaaaccctgtcactactaaaaataaaaaaactagctgggcatggtggtgcatgcctgtaatcccagcactttgggaggctgaggcgggcagatcactggaggtcagcagttcgagaccagcctggccaatgtggggaaaccccatctgtactaaaaatacaaaaattagctggatgtggtggcgctcgcctgtaatcccagctacttgggaggctgaggcacaagaatcatttgaacctgggaggcacaggtttcagtgagccaagattgagccactgtactccagcctgggccacagagtgagactcttgtctcaaaaaaataaataaatacttaagtaactaaatacagataaataaaaaataaaagcacattccatataagtgagtccagcaaaggtttggatgtgccctcccttccctgggaggatggaaaccctgctctggaggtgccgtcggcagtgggagtggcctggggttgacctgccccattgacagccggtcttactgggtgaatgctgagcttattttattttgctttctgctgttcgttaaaggatgatttcaatagagacatcttcctgaaattcaactcagatttattcatatgcgtttcccttttcaaccctttggtggctcccggctggcagagttcaggtgtcttagcacagcgtccttccagggcatatttcaaggtgctcccaggtctggccactacctacctcagtgccatcgcatccctggttacaccctgtgccttcacccctttacacctttctccggctctccacatgtttctgtgtgtgggacactcctgctttttgtcagagttttttggtttatttattttctgagacagagtctcacgctcttgcccagatcggagtgcagtggcacgatctcagctcactgtaacctccgcctcttgggttcaagtgattcttgtgcctcagcctcctcagtagctgggaccacaggccctgccaccaccacgcctggctaatttttatatttttagtagaaacggggtttcaccatgttggccagactggtctcgagctcctgacctcgtgatccgcctgcgttggcctcccaaagtgctgggattaccagcactggcatgagctaccgtgtccggccccagtttgtcttgaggtgtcctctcctttcagaccttgcgtcatgcccccagtaaagtttctgcctctccgaggggcaaaaactgttccagaagcccactgtgacaggatccctcaggttactccctgcctcacttctctaagggacacctgtcacctgcctcccacctggaggccccctgagacaggtcactgaactgaactcagcagtagaaatggaaggaatgttgaggccttcagtgtttagtacagtcttgccttctgtctttctctttctctacttggggtaaattgaggctcggtggccatgggcattagcccggcaggcctcattcagcgtggctgagccaggtgtgttgtgtcgtttcagcatcaccttctccatccccgaaggtgctttggtggccgtggtgggccaggtgggctgcggaaagtcgtccctgctctcagccctcttggctgagatggacaaagtggaggggcacgtggctatcaaggtaggatgaggaccagcggggaggggcagtggggaagctggtggtctgaggaaaagctcagaaatgatggtgtttcttttgactgtccctgtgccagaagcgaaagcagcaacgtctcttttcctcctcctcctgtatctttccactgtctctttctctctcgttctttctgttctgttccgtgctgtcctagaaggcaggattttggtatcatttatttccatctgtctcccagcacttaaaatagtgcccagtatatagtaggcacttaataaatatttattttgttacctctttattaagctgttattttattattattattatcattattattgtgtttttttttttttgagacagggtcaggctctgtcccgcaggctggagtgaagtggcgtgatctcggctcactgcagcctctgcctcctgggtccaagcgattctccctcagcctcccgagtagctaggattacaggcatgcgccaccatgtccagctaatttttatatttttttagtagagacggtgttttaccatgttggccaggctggtctcaaactcctgacctcaagtgatctgcacacctctgtctcccaaagtgctgggattgcaggtgtgagccaccgcatttggccacttaagaaatacttagtagacacacgaagactccctggtacgcagcctgtgtctccttcccttgcgtctctgcctgtcactgagtgtctcttggtctgtttgggtctttttggattgttctttatctttatggatctctgagtatctattcttataaatgtaacaaaacaaaaatgtttatgtggttggaatattttcttagaacattttttaaagggaacagtttaaatttttagtgttgaattcttaatatggagctaaaagaagactgcagttttactgcttttaaatacacagtgtactttgaagtaagttgaaattccccaggagtgagcttaagaggctcctttacaaataatccccactggaaatcaacagcctttgtttgcatttagttcactccccatgaaggccttttcctagtgtaacgacacgtccctggaagttttgctaccagcatttccaggagtgtggtctgcagccagctcatcttgcaggacatttgggcgataaagaaccccaggctcaaagaagcgtgggaaataatgcatactccagccccctccctcttggagacttacagtaaacattagcaaattaaaggctctgacaagtcctgcaaggagaaaaaatctattaactgtttaaccttatgtgtcccaggtgtacttgtccgcacctctttagtgtctgtgcaactgcacatttgtctcttggaatctgcctttgggaatgtcaagtttatgacgttgtttgttgttgtgggttttgagacagagttttttttgttgcccaggctggagtgcagtcgtgtgatcttgactcactgcaacctctgcctcctgggttcaaccgattcttctgtctcagcctcttgagtagctgggattataggcacccaccattactgcacccggctaatttttgtattttcagtaaagacgggattttaccatgttgacctgggtagtctagaactcctaacctcaggtgatctccccatctcggcttcccaaagtgctgggattacaggcgtgagccaccgctcctggcctagttaatgacattgtttttatttcagagcaaaaccctttctttgattatacagtgcctttagaaagtatacattgtggttgggtccaaattaatgacctttagctgttgttttaagaaatgttttatcattactttcaagttcctgccataaaataagatgaatgaaccatgagagctagattaatggaagaaaattccaaatcccgatgggatccacattgctttctgtttccttaaccccagctttctgctatcctggcactattagcatttcaggccagatgattatttattattggttgtttggcctaggtaaggggagtgctagaaatgtatataaaatatttatcttttcccaaatgttttagttggtgtggtttgtgtatattatgtctgaaatttctgtgggttctatggtaaggcaccactgttgacattttggctttttaaaagttaggatattcaagtcagcaggttaattatttgagaatttagagtaagaatgagggtacctgggacctgctgtcagctttgccctctctagaattcccttattcaagaatcttctggctgggcgcggtggctcacatctgtaatcccagcactttgggaggctgaggcaggttgatcacctgaggtcaggagtttgagaccagcctgaccagcatggcgaaaccccgtctctactgaaaatacaaaaattagtgggcctggtggtgtgtgcctttagtcccagctactcaggaggctgaggaaggagaatcccttgagcccggaggcagagactgcagtgagctgagatcttgacactgtattccagcctgagcgacagcaaggcttcgtttcaaaaaaaaatcttcaggggctccccttgcccctctgataaagcccatgctccccaccaagtataggcccccttgctgtccctggtgtgttttctgccagtcgttccctcacaggattgatcgatgttcctgtcacgctggcctttctgttccttgaatgtgccaagtacttttcacttccaggccttcgcatgtgctgttccctcggacttgaatgctcttccctcttctcctcatgaaactgactcattcttcactttttggttcttgtctaaacatatgtttgagctgagcatgatggctcatgcctataatcccagcacttcaggaggccaaggcaggaggattgcttgaggccaggagtttgagaccaggcttagcaacatggcaagattttgtttctacaaacgtaataaatatatagagaattaactacctcagcattttcattagcaaaatacacaaaacaaatatccttactctagcctttattctcatgctgtttgtgatacctgacatatggaaataaaaataagcctttgaaatggatgcttgatataggagtctttgcttcaatttttagcaaggatatttcctcaaagatccttcccggatgtcccaaactaggtcagtcttttaatttttttgagacaggatcttgctctgtggtccaggctggagtgcagtggcacggtgcaatctcagctcgtggtacctccatttcctgggctcaggtgatcctcccacctcagcctcccaagtagctgggactacagatgcacagcgccatgcctggctaatttttctattttttttagagatgggatttctctatgttgtccaggctggctttgaactcctgacctcaagcagtctgcctgccttggcctcccaaagtgctgggattacaggcatgagccactgcgcctagtcaagttagactcttaaaaagtgtcatatatctttttatctttgcgtccaccgtaactgtaatcaagtagttttccgtcacctgagggacttccactctttggaagcaggggttttgatcaccgctgtaggcattgagttaatagctagctactaagtaaataactgtaatcttatcaacgaggatatcaactctttgactcctgatattggagtcagtgattcacctgctgtgggttctgatcccagccctggcatctgttgtcctttgtgagtcagtttccctcttgccaaagcaatagttgtgatgaaaatgacttgtgaagtgaggccctcctagcaggcgggtgggccagctgttgtctcgttgatcagatctgtctgtgtgtctgtctcacctcgttctccatttgcaacttagggctccgtggcctatgtgccacagcaggcctggattcagaatgattctctccgagaaaacatcctttttggatgtcagctggaggaaccatattacaggtccgtgatacaggcctgtgccctcctcccagacctggaaatcctgcccagtggggatcggacagagattggcgagaaggtcagtataggttggatgttggcccctgaatcagtcagctgttgccgcgtaacaaatgctctcacaatctcagtgggctgtgagtctgctgctatcagctgacccggcagggctcagctgggcggctctgctgcacgctgcaggccagctgaacttgggtccaggctgtgggtgtggctcaggtctcacttacagagcttttgctggggaccggggtgaggggtccacagctttccaaaggggggctcttctcatggtggcagcagaggcccaagataggccccccagaaagcatgcaatgtcccttaaagtacactgtcccttctactcacaaagcaagtcacttggccaagctcaaaggcaagggaccaagaaggaagtacattctacctttgtggtcacatgactgcagagtcacatgacagagggcatgctgttgggaggaggggagtcgatgattcatatgttcacagtccctgtcaagatagccataatactgaaaatagcacaatagctaacacttactgagcattttctctttcttttctttctttctttttatttatttatttatttttgagatggagtcttgctctcttgcccaggctggagtgcagtggcacgatctcagctcactgcaacctctgcctcccgcgttcaggtgattctcctgcctcagcttcctgaggggctggaattacaggtgcatatcaccacactcggctaatttttgtatttttagtcgaggcagggtttcaccatgttggccaggttggtgtctaactcctgacctcaagtgatccgctggcctcagcctctcaaagttcttttttttttttgaaatggagtctctctctgtcgcccaggctagagtgtagtggctcactcttggctcattgcaacctctgcctcctgagttcaagtgattctcctccctcagcctcttgaatagctgggactacaggcccctgccaccacgcacagctaatttttgtatttttattcgaggcagggtttcaccatgttggccaggttggtgtctaactcctgacctcaagtgatcggctggcctcagcctctcaaagttctttttttttttttgaaatggagtctctctctgtcgcccaggctagagtgtagtggctcactcttggttcaacctctgcctcctgagttcaagtgattctcctccctcagcctcttgaatagctgggactacaggcccctgccaccacgcacagctaatttctgtatttttagtagagatgggatttcgctgtgttggccatgctgatcttgaactcctggcctcaggtgatctgcccgcctctgcctctcacaatgctgggattacagatgttaaccacctcgcccggcctataacttgagtattttctgtatgttgggaactatgctaaacattttacacgtaattcttccccacagcaagcccatgggtggaatttgttgttatacctaggtaatcattgaggaaaaaggaggcacagagaggccaagtgacttacctgaggccacacagccacagagctgcagagagcatggttcctgtgtccatgttgttacctgctcattttgtcatctctaaaagggccattctctgcctctcaccactgcagaccctccctcctgctgtgctccatctcccaggttttcctgctgcttcacagcaacccccagcccctgcccacctccacaccttggtctgagccttcaaggcctggggtgcctcccctgctgcttgcctggccactttgctctggcaccccatggtggtcgtctggtgtgtcccctcttggaagaccaagagtgcaaagcactggcccatttctgtttttagttacaagccaggggctctgtcggctttcttacgtggtgaatgatgtttaaaaattgagataagcctgcagctccttggaaataaaaaacgaattattggctgggcgcggtagctcacgcctataatcccagcactttgggagaccaaggtgggaggattgtctgaggtcaggagttcgagaccagcctgggcaacatggtgaaaacccacctctactaaaaatacaaaaagttgccaggcatggtgccgtgcacctgtggtcccagccacttagggggctgaggtgagaggattgcttgaacctgggaagcggagattacagtgagctgagattgtgccactgcactccagcctgggcgacagagtgagattctgtctccaaaaacaaaaagaaggcacgtggctgccaggaccccacctcagtgcatgggagtcagggcaggcatctcaggagggactgggcagtaacctgtgatttccagccaaatagggaaacgacgttggcttatctgtcatggtgggagctggcgctgctgctggtccatgcattgtccttcctcctggtgactgggatgtgggctggatttcagcatccccaggccggagccttgcttcacctatatgtggctttgccagacagtgacagatccagagtaagctggcaaacatggcagctgtcaccaacagcagcagtaacaataatatgaccacgtccaccagcgccttccatgagactaagggatcacggccttcccactggtcaacatgatttggtgccgtcagccatcctttgctgagcacttgctgtgcaccacgtgccctgctcagcacctcacgggagattcaggttttctcttttgcccagttgacaggtggggctaaaccctgtgcctgtgatcccatccttggtggtggtggagctggggcctggctccaggtttgtgcaggcgtgacctcatgccttcagcatcaaacttaaagaagaggaggtgggtgcagctctgcagggccttcacccaggacctgctgtgtcctgagcaggctctatgcctttctttctttcttgtttaaagagacagggtctcattctgtcgcccaggctggagtgcagtggcccagccatagctcgttgcagcctggaactcctgggctcaagccatcttcccactcagcctcctgaatagctggaactacaggcgcacatcagcaggcttggctaattttttcttttcttttcttttctttttttgtagagacagggtctccctatattgctcaggctggtctcaaacccctggtctcaagcagtccttccaccttggcctcccaaagttctgggatcacaccacactcggcctgcttctacgtattgtgagtctcaagatttcccaggaaacccactcctgtgtgtgtctctccccagggcgtgaacctgtctgggggccagaagcagcgcgtgagcctggcccgggccgtgtactccaacgctgacatttacctcttcgatgatcccctctcagcagtggatgcccatgtgggaaaacacatctttgaaaatgtgattggccccaaggggatgctgaagaacaaggtgcctgctggcggggtggggcttggtgttgggccgtctcgccctttggttaagtcagaacgtgtcccctttaggagtcctttactttctctggctttctttgtttttaattggactttaaagaacacatttctcatgcttgtcttggaagccttcctaagacagccgtcttgtacttgtctttataggggtaagtcctccgcgcagagttaaattcattgcctctccatggccaagggaggcctctcttcctgattaagtcacagggctggcttcttagcggggaatcccactccaagacattgcctgtgacctagcaggctgcattttcttacttgcagaggtgtctgtgggtagaggggtcggaaaattgccacaacaccttaacataataggaaatagttcctgtgttctttttatagggcagttgtggtaatgggtacacactggctcttttttttctccccctgattttatttttttgaggtggagtttcgctactgttgcccaggctggagtgcagtggcatgatctcagctcactgcaacctccgcatctcgggttcaagcacttctcctgctttggcctcccaagtagctgggattacaggtgcccaccaccacgcctggctaattttttttatttttagtagaatcgaggtttcaccatgttggtcaggctggtctcgaactcctgacctcaagtgatctgcccgcctgggtctcctgcaatgctgggattacaggcgtgagccaccacacccggctgtttctgctgattttaaaactaacacatccccatggggggcatatagattaagaaaaacatgaaaaagaaaaatggaagcagttacacacattccactggttagaggttttgtatttttttcaagtctttttgctctgtgtataaactttttaaatagggttatcttgttccacgtatatatacaggaaacatcgtgctacatgacctcttgtaatcgttcccatacataccactaacattctgtgtaaacatattttaaaatagtacaaaacatttttgaaaattactaagtaatacatgcccattgtaacaaaattgaaaagtacaagaatatggatatcttcttataatatatgtgtgtatgcgtgtgtgtgtgtgtgtgtgtgtgtgtgcatgtatataaagtaaataaagctgggcacggtgagtaatcccaacacttttggaggcctagaccagtggatcacctgaggtcaggagttcgagaccagcctggccaacatggtgaaaccccatctctactaaaaatacaaaaatcagccgagtgtggtgatgcatggctgtaatcccagctactcgggaagctgaggccggagaatgtcttgaacccgggacgtggaggttgcagtgagctgagattgcgccactgcactctagcctgggtaacagagcgagactccgtctcagaaaatatatctaaataaagtaaataaaatagtccctcttcatcctgcatccctaatctttaattcttctcttagagagcaagggttagcaaatctggcccactgcctgctttttatatggctcttgagctaagaatgatgtgtgtatttttaaatagaagaaatctaaacaggaagaatattttatgacatttgaaaatcgtattaaatttagatatcagtgtccataaataaaactttattggaacatggccaatgtattttttttctttttttttctgcagacagggttttcctctgttgtccaggctggagtgcagtgccacagtcatggcatggtagcctccagctcctcggctgaatcaatcctcctgccttctgagtagctcctgggaccacaggcatgcagcaccatgcctggctaatttatttttatttttattttgtggagacaggtctcactatgtttcccaggctggtttcaaactcttggcctcaaggaatcctcccgttttggcctcccaaagtgctgggattacaggtgtgagccaccgcacgtgtcctgttctttaaagcatcgtctacagctgcttcaactcggcagggctgagttggtgccatggcaactgtaagatccataaagctgaaaagattgaccgttagctgtttaaggaaacatatgctgacttctattaatagtttgatgaatgtcttcccaaactttcagatttgcagataaaatgtatgcatgtgcatattttgtagtggttttgggggtggctgacagcgggagttgttttagaaaaaaattaagccagagctgggcacggtagcgcatgcctgtagtcccagcacttttgtaagccaagggcgaatggatcgcttcagttcaggagttcaagatgagcctggacaacatgatgagacccctgtcttgacaaaaaatacaaaaattatctgggcatggtggcacgtatctgtagtcccagctacttgggaggctgaggcaggagaatcgcttgaacccaggaagcataggttgtggtgagccgaggtcgcaccactgcactccagcctgggcgacagagcgagaccctatctcaaaaagaaaaaaaaaaaagaagaaaaaaattaagccattgggctgggcgcagcggctcacacctgtaatcctaaaactttgggaggccaagataggcagattgcctgaggtcaggagtttgagaccagcctgggcaacatggtgaaacgccatctctactaaaatacaacaacaaaaaaatcagccaggtgtggtggcgggcgcatgtaatcccagctacgcgggagggaggctgaggcacgggaattgcttgaacccgggaggcggaggttgcagtgagccgagactgtgccactgcactccagcctggacaacaaagtgaaactctgtctcaaaaaaaaaaaaaaaagccattgcatacaaactgttttgctgtggcaccatccttttattcctttacacacttgtatggttccctccctacctcttgtcattcaggtttttgttaaaaaataaccttccccattacctttgttaaaattgcaaaacccgcacacttggtacacccgttcccctttttgctgtgtttttgccattcagcaagcactattctactagtgttcgtttctcctgcggccctggaatctggggcaggggtctttgtttccttccccttccccagcttttagctcagcacctgaggcgtggcaggccctttgcacatgcatgttacaggaccgtgtgcacaggttcagctgctcctggatgctgttatcgcgggtgcatgtcccaccttcagacctgagttttgcccaccaggtgttcgtcggctcattcctcctttagtcttcactctgccaagctaggcagtctcacacatgtgcactcacgtggccgggtgtcccctttgcccacagacgcggatcttggtcacgcacagcatgagctacttgccgcaggtggacgtcatcatcgtcatgagtggcggcaagatctctgagatgggctcctaccaggagctgctggctcgagacggcgccttcgctgagttcctgcgtacctatgccagcacagagcaggagcaggatgcagaggagaacggtaggggcagccccagggttccacccactcagggtgtctggcaccttgaagggccacattggcctctttgaggttgccaccagccacttggggaaggcggctcctcagggcatgagggtgggagctggatggagccccctaaagaagcaatgtggaaaaccaccttagtccctgcagtgctgaactgggagagagtctcggtgctttatggccaggggatgggagcaccaggcttcagctcagctgacctcagggcagggtctagcgccttcctggaacatgaccttggacctgatgagtttcagggtccttatggcaaaaatgggaatgatggtaattaaagtcctggctctcggggctgagagaaactgaggacatacgtgacacaagagatgtgagggttgtgaggtgaagcacggagttaagctggcaggctcgggttggtgacgtctgggttcaatccccggccgctcatctccccagctatgtgacctgaggcctgcccttcagacccatctgagcttcactttcctccctcataaagcagttcagcagggccagacgtggtggttcccagcacttgtaatcccaacacatagagaggctgaggtgggaggatcgctccagctcaggagtttgagaccatcctcagtagcatggcgaaacctcatctctacaaaaaatacaaaaaatttgccaggcacagtggctcacgcctgtaatcccagcactttgggaggccgtggtgggtggatcccttgaagccaggaggaattcaagaccagcctggccaacatactgaaaccccaactctacaaaaaaaaaaaaaaaaaaattcagatgctattaagtgctttggaggggaaacaaaaaagacaatgccatgggctgaggagtgatgggtgtcattgtggcaactcaggcaggggatagggaaaccctctctggggaggttgcattggcatgggaaggagccagcagggagaagatctgggaagtgttgtgggcagagggaacagccagtacaaaggcctcaggaccagcatgagctcaatttgtttacaaaacaaaaagggtggtgtggccagaccatggtgtgccaggacgtggggggcaggagaagaggtcagcacagtgattgtcctgcagggccttccaggtgggttttggtctaactgccctgggaagccactgagtgtcagagaggcaaagtgaccagccccaggatacacagcagctgctggcagggttggttctcaagttggtctctgagtttctcatcctttgcctggggtgggagctccttctctgcagaggtcctagtgatctctaataagtgctttcttgagatgtaattcacacacgtaggctgggcgcagtggctcacgcctgtaatcccagcactgtgggaggctgacacaggtggatcacctgaggtcaggagttggagaccagcctggccaacatgatgaaaccctgtctctactaaaaatacaaaaattatcctggcgtggtggcgcacgcctataggcccagctactggggaggctgaggcaggagaatagtttgaaccttggaggcggaggttgcagtgaaccgagatcgtgccactacactccagcttgggcaacagagcaagacttcgtctcagaaaaacaaaacaaaacaaaacaaaaattcatacaacatacaattaacccacttaaatcacaaaatccaaccatcaccacagtcaggtttagaactttttttaatcacccccaaaagaaaccccaatccatcagccatgactccctattttccccagcacctccgaagccctaggcaaccactaatctttctgtctctctagatttgcttattctggacatttcatataaatgccatcacaataggtggaatgttgtgactggcggcttttacacttagcgtggtgttttcaaggttcgtctatgttgtagcttcatttccttttattgcggaataatatgccattgtgcagatagaccatactgtgttgatctgttcactggttgatggacattcaggttttttccactttctgactcttgtgaatactgctgtcatgagccctggtggttttaaaggaaaagttggtggccgggtgtggtggtttgtgcctgtaatcccaccactttgggaggccaaggcgggtggatcacttgaggttaggagttcaagaccagcctgggcagcatggtgaaacctcgtctctactgaaagtacaaacattagctgggatggtggtgcacacctgtagtcccggctattcgggaggctgaggtgggggaatcgcttgagcctgggagtcaggctgctgtgagccaaaatcatgccactgcactccatctggcctgggtgacagagcaagaccatgtctcaaaatacagttggatttttgtttcttgccagtgcatgatagctgacattcccttcagcttttaaattatttgattagactgaatttctgcatgttcattcccttgtggttgggaagttctaccttgagtctagcctgtttcttcttgctgcagaatccccctttgtctatctctcagcccgagcaatgcattgtggcaacttctcggtgactttttcactgacctgcttggcaggctacttttaggtgacaataccctttgtgctctctaaatcaaaatgtgtgggtttagctgaatcttttgcccagcgtgaggtctgtctctctacccttccgtccaggtgagcaaaaaatgtccttaaactctcttggccccagataggttccgcacccccgcctttctttcccagctgctagagtatccaagcagtgtatacagaacatggaaggctgccagatgctttgtgatttttgtacacatcagcacttaatttggtgatgcaaatgccgcccaccaccctggcacctcgtgcgttcattttcccagtttgacctccctacctcctgcctttgaggttacatagaagtccttggcagtgggtcttacatcaaactggggcacccccctctctcaccacccacccttttccattgctctggaggggccctggctataaagtcttgacatcagggtctggtcttgcccagccttagccaactcgaagcgccaatgaccttgggtttgtttaaaccacatttttggctcttcctaaaggggaacttttttccttgttggattaatcagctcttttttttagaacacccaggctgaaggggtgcaggtgttggtatttggtttgggagaatccttgaggggggatgggcaggaaccaggcttgtgaatggggccataccgacctctctcccgggatattcagtttactgatttctaagaaatatatcttttttactgtttgtctccctctctccttttttttttttttttttttttaacttttaatggcattccttttattcctaatttattcccatgccataagcttttgtttcttcaatttcttctgggatatatttttcttctgtgcagcctccccttccggtttaggaacagtttgttccctttcaggcaggatcatctggatgtggcagagtgagctcacgtatgggttaatccgaccgaccctgagctctgtaggtccggcgacgcaacttaggtgctttcttcagttggatatgctcaaggaccagagaatctgcatctgaacccttaagttcagtgtgactctctgtatttttaagcatgtgcagcagaaattcagtgctctttttgggccgccgaccttgtggccagccccacttcttggcctgggtacatctaccaactccaccattataatgtcagaatggtacatgttgtttctgtaaagtggcatctttctgatactttgtggccttttgtacgtgcatacctttgatggcctgggcgctttcaggagtgttctttttctttttcttttttttgagacggagtcttgctctgtcgcccaggctggagtgcagtggcgcgatcttggctccctgcaagctctgccgcccaggttcacgccattctcctgcctcagcctcccgagtagctgggactacaggcgcccgccaccatgcccagctaattttttttgtatttttagtagaaacggggtttcaccgtgttagtcaggatggtctcgatctcttgacgtcatgatccgcccgcctcggcctcccaaagtgctgggattacaggcgtgagccactgcgcctggccttttttttttttttttttttttgatacagagtctcacttgttgcccaggctggagtgtagtggcacgatcttggctcactgcagcctccacctcccgggttcaagaaattcttgtgcctcagcctctcgagtagctggagttacaggcatgtgccaccacgcccagctaatttttgtatttttagtagagatggggtttcaccatgctgaccaggctggtctcaaactcctggcctcaagggatcctcctgcctcagcctcccaaagtgttgggataacaggcatgagccaccatgcccggcctcacaaatgttcttaaggtgaacacgaagatttgaacctcttgatctgcatgattctgtggtgttttctggataaagtgaatagtgaaccattttcacagattgcctcaagccccttaggggaacaaatttttaagggatttaaaaaaatggctcattaaccttcatacctggaaggtaaaacacatcttcatgactctggtttctttcttaggaacctaatacctagagcagtggttttccatcaggggcaaattgcccccaccctggggacagttggcaatgtttggagacatgttgggatgtcaaaactggagtggggtttgcccctggcaggcaagcagggtagaggccagcgatgtcgctaaacatcctacagcactcaagacgaattcccccttaccctgccccccgtgacagggaatccccttgccaggacatccaaagcaccacgagcaagaaaccctgtgtgctccgacttcacactgctgaattcttcccttgtcctcttgggagaaggatctttattccaacaatgtggccatttttctcttttaaaaaattttatttatatatttttatgtttttttatggagatgggatatcagtctgttgcccaggctggtctcgaactcctgggctcaagcgatcctcccaccttgacctcccaaaatgcaaatgctgggattataagcatgagtcgcggcacctggcccgtggccatttttcaaaaccttgcttgaaccatctgttaacctcatggcaaatatttttccctcttaagtatttaccgagtttttcttaatgattataaaagcaacatgtgctcatcgtagacatttgcaaactacaaaagagtacaaagaatcaggaaaaaaggtggctcatatgtgtaatgccaggactttgggaggccaaggtaggcggatcacctgagggcaggagttcgagaccagcctcgccaacatggtgaaaccccatctctactaaaaatacagaaatgtcaggaggctgaggcaggagaatagcgtgaatccggggggcagagcttgcagtgagccaagattgtgccactgcactctagcctgggtaacagagcgagactgtctcaaaaaaaaaacaaaaaaacaaaaaaaaactcccgagaaagaacatctttctgccctcactgcccagaaggggagctgttgttagctttggcatctttttcacctgtccttccttcctaggccttctcccttgacaagattgagagtatatcttagagttttctcatctcctgccaccttttgatttcttttcttaacagtgggccataagcacctccccaagttacacaaattagttgtcagcacagagcagctgccgagagagttcatcagacagacccccacattccttctggctgtcctcagaggccggatttcttcctcttttgaggatgaagagctttctctgccgaggctgggggaggaggtcagtgaggcagccagtgaatgccgtttttggtcaaaaatgaggcgttgactataaagctgtgagttgaattcttccctccggggaggctggcctgctggaccttgcccaagcagagttccagaaccttcttgagtaaaggcagtgttggtggaataaacagtgagaggactggcaacggaatacacagacccggggcagcacttaacgtacgtgggtcaagggtagaaacagcacctggcttgacagcatccaaaacccaacacctggtggttgcatgaactcagtgacagtcactgaattacaagtttcgtgtgtttgctttaaaaaaaaaaagaaagaactcttgctactttatagcattctccaccctggcccccagccttcatgtccctcttcttccctgctttgattactttgtggcacttattgctgcctggagtaaattatggatctacttgttcatttattgttgatctcttcctttggaatttaagatctgagggttttgtttgtttgttttgttttgttttgtttgttttgggagtctcacgctgttgcccaggctggagtgcaatggtgcaatctcggctcactgcaacctccacctcctgggtccaagtgattctcctgccgcaacctcccaagtagctgggattacggatgcctgccaccacgcccggctaatttttgtatttttagtagagacggcgttgtgccacattggtcaggctggtcttgaactccggacctcaagtgatccacccgcctcagcctcccaaagtgctgggattacaggcatgagccatcgtgcccggctgctctgagggctttttggttgtctctccatccccaggactaagaaaagagcctgacacatagtagacactcagtaaatgtgttaaatgagtggatgaatcgcaccttggctgttcaaggcatgtcctgcataagcagtgggtaggccggagggctttggatgtttacactgcagataaatacctcagactaggagaaaataggagtggatttcaccccctctcaggtctgctttagaaagcagctttgtcagtcctgcctatgagaggggcccctctggcattgggaagtcagctctgcttcttgacttgactatacacttgtcagtctgcccatctgtctgtcgggtgtgtacagagtgcctgctgtgtgccacaaggccacctggtacgtgagcctctgtgtggaatggtgccccccacgttgagttgtgcagtgtgcatcttgtgtaactgcacttggccacctgctgtgccaggtgctggtgatacagtaatggatatgacccacttcatgcccttgagagctcacagtctgatgggagagacaaacgccaaacaattaagggtatcatagtgctaaatgcagtgatggagggctgcttgagggcctgggaaatcacagagaaggagcccccatcccagcctgggagggtccagggtgatatctgggctaagtcaccttttcttctcctcttgggcacatgtgcatctggctctgtgtggggccagcccctctcaggagcagtgtctgtcctcaaaggggctggagctgatgcccatgccacctcccagtgtcatgcctggcctgcctactgtaatactttatttcttttcctctcctgcgtaaaaacaagcctgaagactgaaggttggtctgcattatttgtttagctctatttatggttaaacacagttatgactttggccaggcatggtggctcacgcctgtaatcctagcactttgggaggccaaggcaggtgtatcagctgaggtcaggagtttgagaccagcctggccaacatggcaaaaccccgtctctactaaaaatacgaaaattagccaggtgtggtggcgggcacctgtaatcccagctatttgggaggctgaggctggagaattgcttgaacctgggtggcggaggttgcggtgagctaagatcacgccacttccctccagcctgggctaaagagtgaaactctgtcacaaacaaacaaacaaaaacccaacacagttatgactttggagaaaggggttggtcttgtgcagtgtgcttgtcccggatccacccagcacgtgtgggatggggaaactgacgcacaaatggagcagacccttcagccattcttgcctctccccctttagaaaagacactcccttcactcctttatttagataggggcttagggcgggagtttcgctttgcttcttaacaatatcttgggtcttctgaattcccaggcagcacagtgatggacgaggaggaagcaggtcagtactgcccgggttggagttggcttggctcatagaatgaggccagagacgggccgagactgtcgctgcatgtctggggaggtgccgtcagatgtctgtgttttcacccctccggttgttcattggttcatttagcacacatttactgggtacctactgtgtgtctggctttgaggctggcactgggggatacagcctgagtccccagatccctttattgtcactgatgaccttgggtaagctctactgtttcatgcatcacgttaccgtgaccagcatgccttgaggggaccatgcttatgaagtgcctggcacacagtggatggacaataaatggcaacagtttgattgtgagctgccacgcatagatcctggggcacagtcaagacacacatgggcccagacaatgcagggtgatcagcgcctgttggggaactgcagcaggtggtggtggggaccctgaagagggatgtcgcctagtggaattccagtggccagactggacccatccctcctgccttctgcagtgtgtggcttagggtcccagccaagggctttttttgtaagcagcagaagctgaatctggccaccttaaacaaacagagggtgtttcctggaaggataccaggtaactcatgaatcaaaggcagaactgagcaagtaggactcaggaaatgggaactctgggagactagactcttttaggacaggtgaacttgaactgtctttggtccttgtagaccactgatgacggttcaaatcctgggagaggggcttttatggggcgacctcagacagtgcccaccttggctgggggaatctgaggcaccctgattgacaggcccaccaaggctgtaggaagagggagagctgatcccttcaaaaagccaacagggggccaggcacagtggctcacacctgtaatcccagcactctgggaggccgaggtgggtggatcacctgaggtcaggggtttgagaccagcctggccaacatggtgaaaccccgtctctactagaaatacaaaagaattagccaggcacggtggtgcatgcctgtaatcccagcttcctgggaggctgaggtgggaggatcgattgaacccaagaggcagaggttgcagtgagccaagatggcaccagtgcaatccagcctgggcgacagagaagaccttgtctcaagacaaggaaaaaaaaaaatgctgagaggatggtggactaactgatgttcagattcctcctcttaggcgcttggtcctcctccgtgcagagtggaattttccagctgcccagttcgacctgtgggctaattggtgggttgagagggtaagacagccttagcgagcactgcatgcctgcagaagctcccagctgaccatggtggctgcgctcagtgacgaacaggagaagtgaaggctgaggcttataggagggtggcctgaggctgctggtaggagagcgggggggctctctgcggcatgcagcctccagatgggggtccctgggagtgttctggaacattctcatccctgcacagagaaagatggttaagggcatggctggttcccagtgtcacacatgtgtgtgaggacaggctgcatgggaagtcctgcttggtatcattcttccttcctgggtgatgtggctatttgtgttttgtttgttttttaagttagtgtttagttagtttagacaaaacaaaacagatgctgacattaaagggaatgtttaaagcagagtttctcagttcctggctgtgcctagaattctctgtagaacctgtttaaaaatgtatttagtaataagcaacacgggggtcgccatcactgaacacttgctgtgccaggcactgcgtgcagtctcgtttcaccctctcgcaaatgaaggttgggtctgctgttcctgttttgcagatgtggaagatgaggctcagacagatttatcatttccccaaggggcacagccaggaagtgagagaacacttcccacatatcacagttcctggagctctaatcgagactcatagcagggactgggctggacacgagggcacctgctcagtttttaattttaattttttggtttattttcttttattcgtgttttttagattttttttttatttttattttttatttttatttttagacagagtctcgctctgtcacccaggctggagtgtggtagcatgatttcagctcactgcaacctccgcctcccgggttcaagcaattctagagcctcagcctcccgagtaggtgggattacaggcatgcaccaccacgcccagctaatttttgtatttttagaatagagttggggtttttccatgttggccaggctggtcttgaactcctggcctcaagcgatctgcccgcctcggccttgaaagtgctggggattacaggtgtgagccaccgtgcccggcggccacctgctcatttataaagccccccgtgactcatttacaaccaagactgagaattcctggcatggagtgcctccctctgtccaggaatgatctgcagccccctcttcccttccaggtgtgtctgtgtctccctgtggctgtttctgcaagattttgcatttttgagctctgcttttattcatgtcatcacccgagcatgttcccagggtcaccctgaccatgctgctggctgcgtatttatcccttttgtatcttctgtcctgggtcctctcccaccttctctggggtcagccctgtggtgccttacattgtgctgctttctctcctggcaccaaagaatgaggcagtcagtgcggagtgggggcagtagtcatcatcatcactgagttattgtgaaccgggaaagagatatgatctgtgttgacacgacacacggtgcccaagtgcacttgataaatgttggctgtcattgtcattgttgatgttccggtgattattgttgatgctgggtggattcttcctgggatcagggcagatatccagctgctgtgtcccttggtgtccttatcagtgtccttcctaattctgcaaccaaggcatctgccagggctggggtctcatctgaagactcaatcagggaagggtccactttgaagctcacctggttgttggcagaacttggttccccagttcaaatgttgaaatactttattactgtggaaacagccactgccccaggtaccttttaccctgaactcttgggacctctctgtggtctaggaactgaagggttaactcctggcactacaggggtctccgggcctctgcctgttggctgatggccttgtcaaattggttatctattttgaatatcacttcttctttcaatgcttgggaatcacggggctatgccctttccctcatgcgtttccttgcatcctggtcctaggaagtgagcttaacatagcagggctactgttttctgggctgggttttacccattgctgctggcacaggatgctggctcaggcccagtgccctcagtggatggagccttctgcacagttgcaaagcactgtccctaccccaagggactgagctccagataccacctgccccacaaccagacagcctgttcatggcctctgcagagcaggtctcctactttctgatcatcctggcggccaggtgctctgtggtctcctcactgaagtggccggtttttgttgcccttggttttagcatctgcctcatataaccccacttgccccctttgtctctcttctgccaggggtcacgggcgtcagcggtccagggaaggaagcaaagcaaatggagaatggcatgctggtgacggacagtgcagggaagcaactgcagaggtaagggcggggaggaaggccccaacctaaggaccctgccctgccagtgggaggacaagaggaggaacaaaaaaaggcctcagccccctgaggtcctggaaggcctgggcttttaccttccctcccaaatcctccaaggaccttgcttttcagagtacagaggcccaaagaaggaatgtggcactctttttgccaggtggcacaactcacacaggcctcatgatttaaccagctgtccacgcttctgacactcgggctccctacatggtgtgggtctttgctcaggtctcttggcggggcctggaaggttcaggctttgtgaagcagcatttgatttaaaactgtctcaaggccaggtgtggtggctcctgcttgtaatctcagcactttgggaggttgaggcaggaggatcgcttgaggccaggagtttgagaccacagtgggtaacatagcaagacctcatctctacaaaaaaggaagtatgctcgtgtttgattatagagggcttccttagatccctggggatttatagcgtatgcagtatattaaccatcctagcttttaaaaaactggctaagtcggccaggcagggtggctcatgcctataatcccagcacttcgggaggctgaggcgggcggatcacctgaggacaggagttgaagaccagcctggccaacatgatgaaaccctgtctctactaaagatacaaaaattagccaggcatggtggcaggcgcctgtagtcccagctactcgggaggctgaggcacgagaatcgcttgaacccaggaggtggaggttgcagtgagccgagattgcgccatggcactccagcctgggtgacagagcgagactccatctcaaaaaacaaaaacaaaacaaaacagcagcagcagcagaaaacagtaaaacaacaacaaaaattgacaaagtcggagcctaaacgtatcagaccgcggagatctgagaaaggatcccggacctgcagttgctacaggggtcaggagagagcaaagaccatgcggcatagcacggtgcctggaacagacaaacacttcgtagatgtcgcttttgccatggttatcatccggacatggttatggtccggaattggtgggtcttggtctcactgacttcaagaatgaagccgcagaccctcacggtgagtgttacagttcttaaaggtggcacgtctggggtttgttccttctgctgttcggatgtgttcggagtttcttccttctggtgggttcgtggtctcgctggcctcaggagtgaagctgcagaccttcgcggtaagtgttacagctcttaaggtggcgtgtctggagtcgttcgttcctcccgctgggtttgtgctctggctggcttcaggagtgaagctgtagaccttgatggtgagtgttacagctcacaaaggcaatgtggacccaaacactgagcagcagaaagatttatcgcaaagagtgaaacaataaagcttccacagtttggaagggtaccccagtaggtggccactgctggctctggcagccagcttttattctcttatctggccctacccacatcctgctgattggtccattttacagagagccgattggtctgtttttacagagtgttgattggtccgttttgacagggtgctgattggtgtgtttacaacccctgagctagatacgtaagttccccacatccccactagattagctagatatagagtgttgattggtgcattcacaaaccctgagctagacacagggtgctgattggtgtgtttacaaaccttgagctagatacagagtgctgattggtgtatttacaatcccttagctagacataaagggcctccaagtcagcaccagactcaggagcccagctggcttcaccaggtggatgccacactggggctgcaggtggagctgcctgccagtcccgtgccgtgcgccctcactcctcagcccttgggcggtggaagggactgggcgccatggagcaggggcggcactcgtccgggaggctcgggccgcgcaggagcccatagcggggaggtggggaggctcaggcatggcaggctgcaggtcccgagccctgccccgcggggaggcagctaaagcccggtgagaaatcaagtgcagcagctgctggcccaggtgctaagcccctcactacccgggctggcggggctgcccggcagctctgagtgcggggtccaccgagccgacgcccacccagaactagcgctggcccgcaagcgccctgtgcagctccggttccctcccgttcctctccctccacacctccccgcaagctgagggagccggctccagccttggccagcccagaaaggggctcccacagtgcagcggcgggctgaagggctcctcaagcgctgccagagtgggtgccaaggccgaggaggcacagagagcgagcgagggctgcgagggctgccagcacgctgtcacttctcaatcttacacagcctaaattctagtgggagactccagacagtgcatgagtgtagaaggatgtaagattttctgtcgaggtgtgtggatgtgtgaagtcctaggtcatgaagcaggaagccccagctccccatttgaattctagattccatccagagttggttccagttgctccctctgccactccctgaaaactcactcttgctttcagatttgagggccacttccacctcactaggccttaactaaagacctttgcacagatctcatgggtaaggaaagtttacccaatcccaggcgctaattcaaagaggggaggtggtggaggtttattcggccttcaggaagtgttttcaggggacacagttctgggggtgcagggatgactcatatggggctcttgacctcagttagcttataatcttgtgcaggagataagtgggtagaggaaagtatagaaatttccacggcagtgagccgcagctgtgttttgcatggtctccataatttcttttcttttcttttcttttttttttttttttgacatgagtctccctctgtcgcccaggctggagtgcagtgtgcagtggcgcgatgtcagccactgaacggaaaactgtgggcgacgcaatctgtgatcatctctgggggtctgcataaagctcatgaccactgatgtgcgaaaagtgcttttttttttttttttgagacagggtcttactcagtcgctgaggctggagtgcagtggtgcaatcacggctcactgcaatttctgcctctgggattcaagcgattctcctgcctcaacctcccaagtagttgggactgcaggtgcacggtaccacgcctggctaatttttgtatttttagtagagacggggtttcaccgtgttggccaggctagtcttgaactcctggcctcaagtgatccgcccacctcggcctcccaaagtgctgggattacaggtgtgagccactgcacctggccaaataatgctttctgagtaacacgcttgcatgaaggagcagtcaggcaagatcccaccccagtgcccaccacatttgtaaaacaagaaaatcgaactagctgggtactttgccctatgtttttcatcatatgttacattttgaatctttttcatgtttgaaaaatgatctacgatgtgccctttctgttatatcttttattggcttttttttttttgagatgaattctaattgatctcagaaaaaaaaaaaaaaagcacgcactttttatataccagttgtcatgggctttttgcaggcccccagagatcatcacagattgcgtttcccatgggtctcattcctgcctgagacactgcctttctctgggtacctataaacctggagagtgacatggtggggtgtggtgcatatattcatatatatgtttacatgtgtgcatgtggaaacactccgtctcttatgccatggttcagacccacaatagcagtcccagcagggagccctccgaccctgcccaaggcatctgtacggttgacacccttgtgctttgcttctccagacagctcagcagctcctcctcctatagtggggacatcagcaggcaccacaacagcaccgcagaactgcagaaagctgaggccaagaaggaggagacctggaagctgatggaggctgacaaggcgcagacagggcaggtgagattcgctccttaagtgatgacagtggctggagtttatagagcgcccactgtgcactgggcactgtgcaaagtgccttgtctatgttaactcacctgtccatcacaacacacctgtgaagatactatttgcagcaccagaaactgaggccagagaggctaagtgacttactcacggtcacccctggtcagcggcagaactgggatttgaaccctggccaactccagggttagtacttgtagtctctgctctattgactgcctgagcagctcaggggggtctcattcgctagaggtgagctggatgctttaaatcagggcttcctgcaacgtggggttcagttgtgcatgagatggtgtccggttgtgcacagacgcattaaatgacagaggaatgtttgtttcatttctttttttaatttttatttttttgagatggagtctcactctgtcaccaaggctggagtgcagtggtgcgatctcggctcactacaacctctgcctcctgggttcaagcagttttcctgcctcagcctcctgagtagctgggattacagaaacttgctaccttgcccagctaatttttgtatttttagtagagacagggtttcaccatgttggccaggctggtcttgaactcctgacctcaggtgatccacccaccttggcctcccaaaatgctgggattacaggggtgagcaccgcgtcctgcctgtttttcatttctcatttggtcctaatgattacgtccctgagaaagtcccagttgggtcctaccctgccttctcaacctatcaaccactatcctctctttgtaacaaggagaccgggttttgagctcctgttttattgtttttaaagatcgtctattttgggcaagtgttaataattctccatttatggtggtgatccaaagtttatttttaaaaataaatgtggttttttttgtttttgtttttaaagggaatggaatttttaaagtaggtaaaaaataagcatgcagataaagaaaaacaaaaaaaaaaacatgaaaggtggtagccggggagtggggctggggcactttctcttagatctgcccggatgtgtccagagcttccgaggactgtctgttcctggcttcttccttaacttgtcatcagagtcaggaccgtaacaaggggcagaggtgactctggtgtcctctctcgccttacccttagtgaccctccaggaagccagagaagttaccccaaatcgcaggacatgggaaggaagggccagagatgccaggcccatttaatcctcatttaactccaattttatattcaaggaacatcaaagccagggggcttgttacttgtcaaagttggacccagagtggagccaggcacaacacgcttatcgtttctttgtgtcttttttttttttttttttttttttgagacgaagtcctgctgtgttgcccaggctgtagtgccgtggcgctcaccgcaacctccgcctcccgggttcaagcaatttacctgcctcagcctcccgagtagctgggactacaggcctgcgccaccatgcctagctaatttttgtattttcggtagagatggcgtttcactatgttggccaggctggtctcaaactcctgaccttgtgatctgcctgcctcagcctcccaaagagctggtgctgggattataggcatgagccactgcgcccggccttttttttttttttaatttgttttcttttttttttttctgagacaaggtctgactctgtcacccaggatggagtgcagtggcacaatcatggctaactgcagcctccacctcccggattcaagtgattctcccacctcagccttccaagtagctgtgactacatgtgtgcacccccacgcttgactaatttttttaatttttttgtggagatgaggtttcgccctgtcgcccagactggtcttgagctcctgggctcaagtgactggcccgcctcccaaagtactgggattacagatgtgagccaccacacctggccacacacttgtcatttctgacccccgagcccaccacattccactactcatgagaaagaggttcctgaacgctgcaggctaatttcagggacagcaggcaacttggccgcatgacaaagccaagtggtgaaataaacacattcttaattatgacctgtctcctcacccacatttttcattttccagaatggggacttgaaaactcaaaaggaagcagccagttacacatcagacctgttatctttcacctgttacctttcagctagaccgtagggtcagatgatttttgtttttttttctggtgaggggcagagcctcactgtgtcgctcaggctggagtgcagtggtgtgaccaacgctcactgcagccttaagcttctgggttcaagagctcctcctagctcagcttcctgagtagctgggactataggtgtggaccaccacacctagctaattttaaaattttttgtagagacagggtcttactgtgtttcccaggctggtctcaaactcctgggctcaagtcattgtcctgccttggcctcccaaagtgctggcattataggtgtgagccaccgcacccagtccagatgattttcatgacccaaaattcagcatgaaaagcttgaaatgacaatgagcacagacacgggtaaagatccctggaatttcttgaaaccaagtcaggtggtttaggtgggggctggcctaaagcagattgccctgtctctcatgtcaggcggctagacacatttgtttagccccatgctgggctccacagggaatataggagggaaagaaactccaaccttcacctcctggagcgaactgggcactgggaagatgggtgagatggtattctgtgctcagagtgaaaagagttggaggaggctggcccagttgtggtgttgaggtgacatttggccttggttgccaggcaacatgtcacacgttgcttaaaactcattggtggcttctgctttctgtcagtcttggctaaaagttggaatcctgacccgagtctcccatgccatgtgtggtctgactgcgaccggtttttccagcctcttgttccttgctgccccatgatctcctggctccagccaccagtgccttctctcagttccccagatgcactgtgttccctcctacctcagggcctttgcacatgctggttctgccaccttttttccattttcagctggtttaactcctttttttttttttccccctggaggcaatgtctccctctgtcacccaggctggtgtgcagtaagtttggcttggtgcaacctccacctcctggcttcaagcgacccttgtgcctcagcctacaggcatgtgcccccacgcctgactaatttttgtattttttgtagaggtgagatttcatcatgttggccaggctggtctcggattcctgacctcaggtgatccacttgccgcagcccctcaaagtgctgggattacaggtgtgtgagccacgatgcccagcactctttatttttttttattttttagagacagtctcactctgtcacccacgctggagtgcagtggcgcattctcggctcactgtaacctccgcctactgggttcaagccattctcttgcctcagcctcccgagtagctgagatgacatgtgcctaccaccatgcccagctaatttttgtattttagtaggcaaggggtttcgccatgttagtcaggctggtctcaaactcctgacctcaggtaatccacccgcctcggcctaccgacgtgctgggatcacaggcatgagccactgcacccagccttggtttaactctttaatgtcacttcctcgaagaaaacctcccccaatacctctctagactgcattaggtcaggttgtctgattttatactcacgtggaattgtgcaccgtttacagcccttctctgtgatgacgcatttatctgggatgattttatgggagcctatctcaccacgcgactggaagctccatgcatgagggcagagaccctgagtttgtctcttttttttgagacggagtctcactctgtcgcccaggctggagtgcagtggggcaatcttggctcactgcttctacctctgcctcctgggttcgaggaattctgcctcggccttccaattagctgggattacagatgccgaccacacacccggctaactttatatttttaatagaggcaggattttgccatattggccaggctggtctcgaagtctctacctcagttgatctgcccgcctcagcctcccaaaatgttgggattacaggtgtgagccacggcgcctggccctcgactttgtttactgctgactttgttgaatagctaaaggggaggggtgttctacgtaggagcaaaggcaggcagctgggtggcacagtgctggtgaagcccccgaccttgtggggctggggctggggctgggtgcgtgcatgtgctaagctgccttatctcctgtgatctccaggtcaagctttccgtgtactgggactacatgaaggccatcggactcttcatctccttcctcagcatcttccttttcatgtgtaaccatgtgtccgcgctggcttccaactattggctcagcctctggactgatgaccccatcgtcaacgggactcaggagcacacgaaagtccggctgagcgtctatggagccctgggcatttcacaaggttggtgccgctgtctcccaccccgcctgatttgggcccctgttgtggctttgtctaattatagaaatggatccttagagtcctcagcgttttgtgggaccccaaaccaagccaaacccagaaaaatggtagctgtcagctagtagacactcagatatttgtagagtgggtgtttgagtgctttgttcatatgggccttggtggtagacgggaggagtgctccagtgtgcccattttacagatgaggacagttgagaacagaggcctctggaagcactgagggttgggaggacccccttgagcatgtttgctttgtcacagtgacagagcttccatgaggtctcatttgcggacttttgcctgctgagtgagggcggaaattggcttatactagtaattcccaattatgggcagtgttgtccctcagggatgtttgacaatatctggagatgcttttggttgtcaaaagattgagaaaccctgctgttggccaggcatggtggctcacacctgtaatcccacactttgggaggctgaagtcaaaggattgcttgaggccagatattcgagaccagcctgggcaacatagtgagaccctatttctagaaaaaatagataaataaaataaactacaggtcacgtggtggtatgcgcttgtggtctcagctacttgggcagctgaggtcacaagattgcttgagcccaggagtttgagcctacagttagacctatgattgcaccactgccctccagcctgggtgacagagcaagaccctgtctcaaaaaataaacaaaaaaaaaaaaaccctgctctatactgttctgtgtggtcctatgggagtcctcaaatgcagcagcgttgatattaacagctggcatttactgagcatttacttggtgcttggatttgttctaaacacttccacgtgttttaacttattttatccttgcagcagtcctgtgaggtaggagttaatatttccctcattttggagatacagaaactgaggcccggagaggttgagtcagttgccaaaagtcacacagctaatacatggcagcattggcattgaacaaggcagtctggctcaggagctcacgctgttatccactgtgctacgcagtatgtgagccatgtttgcaaatacacatgtatggtccatatgatatatacacagtaaatggatagtcttgacacatttgagtacttctgtatgccaggcacattgccaggtggggacttcacattccacagtgctccgaggtcagcgtcattgtcccattttacagatgaggaaactgagagattcagtgaccagtaggaggtcccatagctggtaagtggcagagatgggatttggcagcattggctccagagcctgttacttgagcccctgcctattgggtgtcttcccgattaaagaggccgagatggaagcctctctgttcctaggaagttgctgctctggaacacacagtgcgctcctgtggattgtttgagagaagcaccagtgtctcaggatctccaggaggtggctttgggaaaacccagcggtagcagagcacacatggactccttgagtctctcaatccctcccctcccctctccttgccattaggggaaaggactgtggcctacaaattataattgagggaaggtagagaacagagagggtgtggtattacctgaactcacacagcaacaacgtctgttccagagctgtgctgtctggtgcggtagtcacaagacacaggtggctattttaatttcagctgttaaaattaaataaacgttgggcgcagtagctcacgcctgtaaccccaacactttgagaggccaaggcgggtggatcgcttaatccaggggttcaagaccagcctgggcagcatggcaaaaccctgtttctacaaaaaatacaaaaattcgctgggcgtggtggcgcatgtctgtaatccctgctactcaggaggctgaggtgggaggattgcttgagcccaggaggtcgaggctgcagtgagccgtgatcacagccctgtactccatcctgggtgacaggatgagagagaccccatctcaaaagaaaaataaaattaaagatttattcgattagactagacacgtttcaagtgctcagtagccatcatttcagaaaattatctcagcactgttctaaaacagcgatccctagcctttttggcaccagggactggtttcatggaaatggtgggtggtgatttcgggatgaaactgttccaccttagatcatcaggcattagttagattatcagaagaagcgcacagtctaggtcccttgcatgcacggttcacaatagggttcgcactgctaggaggatctaatgccaccactgagctcacaggaggcagagctcaggcgctgatgctcaggaggtgaccaccactcacctcctgctgtggggcctggttcctaaccggtcatgagctgctgccaatctgtggccccggggttggggacccctggtctagaagaatatggcatggggattaagagcaggctgtctggattaaaatcccagttctgcttctgctaggcacagtatactaagggcaaaggcgttcacctatctggacttcagttttcttatctgtaagttgggtagtaatagaagttattcagagtcatcataaaaatcagttacatgtaaaacccagcacagtgcttagcacataggaagtaccctctgaataatagctgccattatcatcatcattattattactatttttttttttttgagacggagtctcattctgtcgcccatgttggagtggagtggacgcagtcttggctcactgcaacctccacctcccggattcaagcaattcccttgcctcagcctcccgagtagctgggattacaggcgccaaccaccacgcctggctaatttttgtatttttaggagagacggagtttcactgtgttggccaggctggtctcgatctcctgacctcaagtgatccacccacctcggcctcccaaagtgctgggattacaggtgtgagccaccatgcctggttcatcattattattattattagaagttgggagtccaggcctgcctcgtccacatggccactcctccctgcagtgcctggtcagctccctctctgcattgtggagttttaactccgagtgtctgcagggatcgccgtgtttggctactccatggccgtgtccatcggggggatcttggcttcccgctgtctgcacgtggacctgctgcacagcatcctgcggtcacccatgagcttctttgagcggacccccagtgggaacctggtgaaccgcttctccaaggagctggacacagtggactccatgatcccggaggtcatcaagatgttcatgggctccctgttcaacgtcattggtgcctgcatcgttatcctgctggccacgcccatcgccgccatcatcatcccgccccttggcctcatctacttcttcgtccaggtaaggggtgaggtcttagtgttcgggacaagccctactgtgcattatataccagtgttacctaaagccttgttttatcttaccatgtccccagtgtggtgcttttgaagcatgtagatttgtttttgtcagtttcgaatacctaaattgtttttttgctcacaataacaaaatgcactttttttgtggaatgcagttttttcctaagttttacttttccacctgtcaattcaaaaaggaaacaaaacctatcactataaagacaacttcattattaaaatttctttttttttcttgagacagagtctcgctctgtcacccaggctggagtgcagtggcacaatcttggcttactgcaacctccacctcccagttcaagtgattcccctgcctcagcctcctgagttaacaggtgcgcaccaccacggccggctaatttttgtatttttagtagagacagggtttcaccagtgttggccaggctggtctcaaactcctgagctcaggtgatccacccacctcgacctccccaagtgttgggattacagatgtgagccactgcgtccagcctaaaatttcttcaagtataaaattctttagttcttaagcctcctgcaggaggcaggaactaaacaaaaaacatgactaatagcagcctaaataagatagacgttttctttttctctgtcataatagaaatttagaggtaggctgttcagggctggtatggcagcttcatgagtttaatatcccagatacctgcttttatttaaaaatttaaaaaatcttaccatatttatacaagcctttcattctttctttctttcttttttttttttaatttgacatggagtctcgctctgtcgcccaggctggagtgcagtggcgcgatctcggctcactgcaagctccacctctcgggttcacaccattctcctgcctcagcctcccgagtagctgggactacaggcgcccgccactacgcccagctaattttttttgtattttcagtagagacaaggtttcaccatgttagccaggatggtctcaatctcctgacctcgtgattcgcctgcctcagcctcccaaagtgctgggattacaggcgtgagccactgcgcccggcccctttcattcttaagttggcctcatggtccaaggtggctgctggagctccagccattatatctatatttcagtcagtgagatcaaggaagggaagtagggcaagggagcatatgggtgctgaatcagcactactcccttatctgcaggcacacattctaagactcccccaatggatgccttaaactgcagatagtattgaatcctacatatcctgtttttttctgtacatacatacctatgataaagtttaatttataaatttggcataatagattaatagcagtaatttataataataaaatagaacaattataacaatatgccagtatcactacttctccacattagaggcgttatttttattacttttttttttgagacagagtttagctgtgtccttcaggctggagtgcagtgatggaatctcggctcactgcaacatctgcctcccgggttcaagtgattctcttgcctcagcctcccaagtagctgggattacaggcatgcgccacacccagctagtttttgtatttttagtagagacgaggtttcaccatgttggccaggctagtctcaaactcctgacgtcaagtgatccgcccgcctcagcctgccaaagtgctgggattacaggcattgacccactgagcccagccaggggcattattgagtaaattcggattacttacccataagcactgcagtacaatggccgtcagtctgataaccgatatggctattaagtgactaaactgacagggagggtctgcagcatggacctgctggacaaagggatgattcacaccgcggatgggactgggggggatttcatcacactactcagaagggtgcacaatttaaaacttacacattatttttggaccacagttgaccatggataaccgaaaccatgtgtgttagtttgtcctcatactgctatgaagaaatacccaatactgggtaatttattaaggaaagaggtttaattgactcacagttccgcatggctgaggaggccatggcagaaggagaagcaaacatgtccttcttcacatggcagtaggaagaagaatgagagcaccacgaagtcggggagcccccttataaaaccatcagatcttgtgagaactaactcactatcatgagggttgggggaaactgcccccacgattcagttatctccacctggtccctcccatgacacatggggattaagggaactacaattcaagatgaaatttgggtggggacacagccaaaccatataaccacggaaagtgcaaccttggattagagggacacctgtacatctaattgtccagaacttagtcatgggaccacctctattcacaagggaccctggaaagtgccgtgttttagctgggcacattgcacttcccagcaaaaactttcagttgggcctaggcacggtggctcacgcctgtaaccctacccctttgggaggccgaggcgcgtgtatcacctgaagtcaggagttcgagagcagcctgaccaatatggtgaaaccccacctctactaaaaatacaaaaattagccaggtgtggtggcatgtgcctatagtcccagctgctctgaaggctgagacaggagaattgcttgaacctgggaggtggaggttgcagtgagccaagattgcatcactgcaatccagcctgggcaacagagtgatactctgtctaaaaaaaaacagagaagtttctgttgggaaaggagaaattgtgtaggcagtcagtcgtctctgctgcatcccttctgcagaaacggttatatgttctttgttctttgaacacatgtggtttcttaggatatcgcaggatagataatgttttcaattgacaggtggagcatcttgctaagtgggagagctgagagtgcaacctcaagtctgtccaattccaaaactgctgttaccgctaaaggattaaccgcagcacaattgccagtagggatgggttgtttagatgggagcattccagctgcaaagcaaaacaagagtaagaaaccatgaggctcaccatatctcaaaccacgctgcacagctgttcaggtggcatccagggggccttggttcaatcatgtggcccctgcgccccaccacactgtggcccaatgattgatgagaacgaacagtgatggaatcagagagagtaggtccagttcctggagtctcgttatatcctcttgaaattggtgccagcttttttttttttttttttttcccctgcatttaccaaatatgttatctgtgttcatacgcaagctggaaaatttcctgaaagacccaaaaagaacaaaacaggccaaatgcagtgttgaaggcaacttaaatgtctgccaatagcaggaccttgggtacaccgtggagcaatgtggctttgagcagggataattagaagacgcagctgttggagcaccaaggatttttatttttcaacaacaaaggaaatgattttagcaaaggaccaagttctaggtgcactgtcgttatcaccgagatgaaatgcataatgtgtgtgggcaggactggaagggaggcagatacatgaaaacatcgtctttttaagggttgagattatagaatagttaattttttaatggcttttggctaaatttacatttatcctctcactaggcagtctcattcctaagtgtatattaaaaaaaaaaaaaaaaaaaaaagagcaaaggcagtgcttagaatgttctcagcatcttgattcataatcgcccaaactggaaacagctcaaatgtccattaacaggaccgtggagaaataaattgtgatataattatacaatttatggttgagtagtaaaaaggaatgaaatgctaatacacaacaatttgggtttatctcagagatgttatagtgatcaaaagaagccagacgaaaaagagtaggtactgtgagatttcatttatatgaagttcggtcgggtgcagtggctcatgcctttaatcccagccctttgggaggcctagacaggaggattgcttgggcccaggagttcgagaccagcctgagcaacatgggaaaacctggtctctacagaaaatacaaaaattagctgggtgtggtggcgtgaacctgtagtcccacctgcttgggaggctgagatggaagggtcacttgagcctcggaggcggaggttgcagtgagctgacattgtgccagtgcacttcagccttggtgacagggcgagttgtctgaaaaaaacatcagatcggcagggcaggtggatcacctgaggtcaggagtttgagaccagcctggccaacatggtgaaaccccatctctactaaaaatagaaaaattagccaggcacggtggtgggcgcctgcaattccagctacttaggaggctaaggcaggagaattgcttgaacctgggaggcagaggttgcaatgagccaagattgtgccactgcactccagccagggtgacagagcgagactgtcttaaaaaataaaataagatcattcctgaacaaatattcatctcaggttagatttttccagtaagtaaggttcagaggcagtggcaagtggaggaaagtgaacaggtaacacacttgagagcgatttgcatctggattgttcagaaagcaagctggtaagagaggaaggagatgtggtccagggtaagatggggcagatcacctgggccttcagccatgcagaggggtctggatttcatgggaggcggtgggaacagctggagaagaaattatatctgatccacattccaggaattggcagaacagctattctgagactgcgtggggttgtgcggtacctgggttcacttacatagcttctggggccccagaagactctccatctgtgggttgcaattaacgcccgtgccgccacccaggaagaagctgccaaccacagaggccttgtaaaagccacctgctgctattgatgctttttgttggactctgccccaaagcagcccagtacacctggcccagggcaggatgcagggaggccgagttcctagcaaccctttgttagttttcccagctctcctgtcgataagcaattgtaggcaccttgtggaatcaggaaccccgggctcaccagttccttttgcgtagatgagaaaaacctaggctaggagagcgcagtgtcctcacatggctggtgcagcctctgatccacagctccacaaagcttgcagaaggtggttggcttttgttctgaatctaacaagacttatcgggaggctcttggtgcctggcactggctgaatgcccaggttgggggaggcagagcagatgaagcatctgcccgcgagggtgggtggagctgcttgtgaaacgtatcatcgtagcccgggagctgggacactgaagcccggagaaggtgctcatggaggatgggaagggcttcccgaggaagtgacatctgtgctcccatctgctgggtgatgaggaatggcctggacgggatgggcatggtgggtggaggcaggcggcctgtgtgcagggaaggaaggggagagttacaggatgagatgagttgagggaagaagcatggttggcaactctaacagcgctgggaggccatcggaggggggtgacgagattgaccctatcctcatgggcatctcagctgggctgagtgtgctggaaccggccattgcatggacacagtcactcctgaggggatgtgatcaacaggcggaattctgtcacttaatgataacaatagtcaccagctaactgaatgcttactgttaggtcaaactatatgaaactgctaatacttatttcttatctacagaaacagctatttcctgtggttcaacctagtattaccaggcactgtgcttagtgacatcatgcatatctatatgatttatgaaataatgtgtccacgcaaatacacatcacatgtaagactgtaactcttacatgtcaccctcacaatgaccccgtgaagcaagctttgttttgtttcgtttgttttcttaataatattttatttttgtagagatggcattttgccatgtgcctgggctggtctcagactcctggcctcaagtgatctcccgcctctgcctcctgaagtgcgggtattacaagcatgagccaccccacctggccgagcaagccttgttgttcccattttacagataaggaaactgaggcttagagaagtaaagtgttagtcgtgtttatattgccagtcagtagttgagtcaggatttgaactgaggtctcgttgacctcaaagcctatgctgaaaaccacactgctggttccagaaaaccctagaggtgaaaggcttcagagaggcagtacagggtagaggttagcactttgcagcccagatggcctgggtttgaatcccagttctgccccttgctagccatgtgaccttggggaggagattaactagcttctttgtgccttagtctacccatcacatataggaatgagcacctcaggttttttgtgaggattgaatgaactgatgtttgtaaaactgcttagaacgatgcctggggctgtgggctttgtataagcgtgagctattattgtcactgtccttgtcattggtggtgctattcctgtggttcaccaggtgagtgggcacccctgtgagggcagcccggctctaacattttgcctcctggaggtatcggttacgtctagatgttctccagcacagccctgccctgggaggatggcaggagggaaccttcatcaactccccgcgtctgttctctaccccagaggttctacgtggcttcctcccggcagctgaagcgcctcgagtcggtcagccgctccccggtctattcccatttcaacgagaccttgctgggggtcagcgtcattcgagccttcgaggagcaggagcgcttcatccaccagagtgacctgaaggtggacgagaaccagaaggcctattaccccagcatcgtggccaacaggtgggcatggtgggcctgcaggagcgggtggaggaggccgccttagcaccttgtctctttgcctcgatcttttcctcgcaccttgagctgggtataaagccaaaccccggccttgcagaaaggatggagaggcttgatgagcgcggaggacagatgaatcattaagagcagacagcggcactgtagacatgcagtgcccgcggcatttaagtgcagggacacagctcttctggagtcagaaagccctgcaagtgcttcccgttaactgtcatcctagtgatgcaagactgccagcgaccgactctgctattgagtatcttcataccgctgttcccgtctgggggtgatcatgcacccctgggtgatgtgtgtcagaagcaatttactaatactaagctaaaccatatgagattgtcatcttgtgggccagatgtcatggctcacgcctgtaatcccagtactttgggaggctgaggcaggaggatccattagattccaggccagcctgggcaacatagcaagacccccatctctcttaaaaaaaaaaaaaaaaaaaaaaagtagcccatcatggtggtgtgtgcctgtagtcctagcttctcgagaggctgaggctggaggatcgtttcagcccaggagttcaaagttgcattgagctatgattacaccactgcactccagcctgggtgacagagtgagaccctgtctctggaaaaacaaaaaaaggagatgggggtgggagattgacatcttgtggatcacagataatagcatcaatccaaaagaggcagaagtttgctaattatttgctgaatttagagaagtgtccctctcacccatttgcatccttatagacttttctgaaaaagtgacagcaccccagaggtgtcccataaccattagcccgtcttacacactctaatcccatagcgtaagtctgggtgggctaaccctgaatgattacagaccttgacttcccttcagaatttttagggagtttgtcacaatctggctgtgtctgtcggagtagtgaggatcagtcacttggttcataagggctgcaatggagaaaagatcaacaccccatcttcctagaatgctttatattttagaacattaaaataatagttctagtgctatatgatatcatacgaagcctagctttaaacaaataagatggccaggcgcggtggctcacatctgtaatcccagcactttgggatgccaaagtgggtggatcacctgaggtcaggagttcaagaccagcctggtcaacatggcaaaatcccatctatattaaaaatacaaaaaaattagccgggcatgatggtgggtgcctgtacttgggaggctgaggcaggagaatcacttgaacccaagaggcagaggttgcagtgagccaagaccgcaccattgcactccagcctgggcaacgagagcgaaactctatctgaagaaataatagaagagaagagaagaataaaataaaaagtaaaataaaatagttctgatggtacatgataccatactaaacctagctttaaacaaataagatgaccaggcacattggttgacacctgtaatctcagcactttgggtggccaaggcaggcgggtcacttgagcccagcagttcgagaccagcctgggcactctagggagaccctgtctctaaaaacaaaacaaaaaaccaaaaatttgccaggtgtggtggcatgggcctgtagtcgcagctactcaggctgaggcaggaggatcactggaacttggaaggttgaggcggcagtgagctgtgatcatgtcatccacactccagcctggatggcagagtaagaccccatctcaaaaaaacaaaatgacagaaaacatgatttctgtttctattttaaagggtaaaatagtatattttaacactttgaaatgaagagtctgggcttgggaacgttacaatgatgtttactcgtactagttacgcactcccctcccagatctgtctcgtaacaagagactgttattttctacttgtttttagccaaaaggccgagaaacgatggttattttaaatccctagtgtctcttacagttgatgtcttcttagtatttaggaatttccaggacatctttttgttgttgttaatgcactgtgtgtgtgtgtgtgtgtgtgtgtgtgtgtgtgattataggagtgacccactacgcccggctgtgtgtgtgtgtgtgtgtgtgtgtgtgtgtgtatgtgtgtgtgtgtgattataggagtgacccactacgcccggcctatgtgtatgtattttaaaggcttcaatgagaaaaaagttggttcttaaaaaggcaagcttcagattccagggaagattgcctctggagagctctgttttaatccatgggtttgccagattaatgaggatttactggcctcgtgccttcggccctccctaccctgcgcccattgtgcatgttttgaaaaagcagtgccaggaaggactctctctggaattactgcggagttacttgagttagcaaagaatccccttcctcccccaagagctgtaagccaagtctctgtagagctgactccatgcctgtttgtctgcctgtgtgtcttggcgcaggtggctggccgtgcggctggagtgtgtgggcaactgcatcgttctgtttgctgccctgtttgcggtgatctccaggcacagcctcagtgctggcttggtgggcctctcagtgtcttactcattgcaggtaagaggggatgctcttggctggattattaaagtctgttaatgggggagccagttgtccttggctttggattccagctccaacaggaatgggggagaggaacttgagaggtacggagtttgaggagcaggtacagtgccacagtgcctggtgaccaactagagcaggagacggatttgacatgtggccaggattttccccatcagtcacacagattccttagtggcccaagaggatacttccaggtacgaggggaatgcttttaaagctatgaatttccctctaagaactgctttagctgcatctcacaaatgatgatacattgtgttttcatattgtcacctggctaaaaatattttccagtttcttattatgtggcccatgagttattttggaaatgtgtgtgcttaggagatggcaatgtggcaggcctgggtgatggctatacctggggttgctaatttcggtacctttcttacctgaatgtttcataactcataaccttttatttttatttatttattttttttggagacggaatctcactctgtcacccaggctggaatgcagtggtgggatctcggctcactgcaacctctgcctcctgggttcaagtgattcttctgcctcagcctcccaaatagctgggtttacaggtgtgcgtcaccatgcctggctaatttttatatttttagtagtgactgatggggtttcgccacatcggccaggctggtctcaaacccctgacctcaggtgatctgaccgcctcagcctcccataattcatacttgttgaaaataatttgtttcctattatctcagtggaaaaaaagaaaaaggaaagtcaagtacgcccgcttactctagaaatgccacgtgactcttccactcacaggtcaccacgtacttgaactggctggttcggatgtcatctgaaatggaaaccaacatcgtggccgtggagaggctcaaggagtattcagagactgagaaggaggtaggcaagggcccctggctggacctcttggtctttggtgtagctttaccccaaggagatctctggaccctatcctgtgcacctctgcctctgagctggatacctcaccaggtagaagtgcatcttaacgcttgtccagtctttttgcagcacttatttagagcccggttttagggtgaaaatagtttaccggctttacccaagatctggggtatccatatacgagactgtgggatgctgtcagggcattcagaaggtattcacattgtgaagaagtttccccctctatttctctttcataacttctgatggtatcacagagaaagtcttagtctggggctagcaggtctttaacaccttagcaattgagatgatctcccttcaacagacagataaacagcagccctcacacttggagtcttcaacaggacggattctgtctatcagaaataaccttctgttatttgttatgaatttggtttttttgtgtgtgtgatggagtctcactgtcacccaggctggagtgcagtggcacaatctcggctcactgcaacctcctcctcccaggttcaagtaattctcctgcctcagcctcccaaatagttgggattacaggtgcctgtcatcatgcctggctaatttttgtatttttagtagagatgggggtttcactaagttggccagtctggtctcaaactcttgacctcaggtgatccgcctgcctcagcctcccaaagtgctgggattacaggcgtgagccactgcgcctggcctgttatgtatttgtataggggactcctgttacggaaaataatactacttttccttttgtgattgtaataaattttcctcttaagtaagttgagaaattaagtctaagtgacttgattaagcatattaaaacaacaagagaatgagtacatgcatactacacgaatgatgtagctgggaactgaccaaagtttgggaaaccctgccgttattgaaccccagtcccctttttatagatggagaaaaagggaacctggggagggacaacagctgatccaaggtcccacgtggcttggtagaacagctgggactaggacccgtgcctccagtctttgatgttgcgttgcccttaataactgccttcttaggccctgaacagcagcacaagtaggaacagcagtgataatagataatcacaataatgcctggcgacacccccaccctacattaatgataacagggacacacatagtgccttgtagaatgtcaggcccagacttaaacgtttaatatagagtaatgcactcagtctttaccccgctctatgactgatttttgagacacggtctcactcttgcccgggttggagtgtagtgcgatctcattcgctgcctcccaggctcaagtgattctcctacctctgcctcctgagtgtctgggaccacgggcatatgccatcacaccggactgatttttgtatttttagtagagacgggattttgcccagactcatcttgatctcctgagctctagtgatctgcctgccttggcctcccaaagtgctgggattacaagcgggagccaccatgcccagcccagccctataatttagatgctactattacccccattttacaggtgaggaaactgagacaaaaagctgaagttacttgcccaagatcacatggctggtaaatggcagacctaggcgttgagcctgtgcctcctcagagaccctatccagtgccatgggagtcatgctacccggcctcctgaggagagatgccccttgggagtgagaccaaggcctctgtaaggtctgtcctcctgaggaattcacagaggtgacctcggcccactcctttaacattctgactgggtgaaccaggtcccatgtcacgggtgagcattgtaagaatggcgtgagtgcccccgtgaggaaccaagggtgtattacaccggcggcttccaacttgacactgaatttaattcacttacaaggtatttcattaggttttttttttttttttttttagatggaatttggctttttttttgcccaggctggaatgcagtggcacgatctcagctcactgcaacctccacctcctgggttcaagtgattctcctgcctcagcctcccaattagctgggattacaagtacccaccaccccgcccagctaacttatttcattagtttttataatagcctcattgacatgtgaatttcacatgccatggaattcacccagttaaagcgttcagttagattgaattcagttttttttttgtttgtttgagacttaagtctcgctccagcctggagtgcagtggcatgatctcagctcactgcaacctccttctcctgggttcaagcgattcccagcctcctgagtagctgggattacaggcgatttttgtatttttagtagagaagggatttcaccatgttggcccggctggtctcgaactcctgacctcgtgatccacccgcctcagcctcccaaagtgctgggatcacaggtgtgagccaccacacccggcctgagttcagtttttaaaagcattttacttttgactgacttttatatttttagaaggatcgtgtttgacaaacccaagagaaagtaattgtcctcattagtcctaccactattctgtatttgcatgtatttttatatatagatagaaagttccacatacttctctccattccgctcactgtgttgttatagcatctccccttcaattatgtacataaattataaaatagagatacacttgttgttttaaaaaagaaaaaatcaatacagggctggacacagtggcccacgcctgcaatcccagcactttgagaggccaaggtgggtggatcacttgaagccaggagttcgagaccagcctggccaacggtgaatcccgtctctactaaaaatacaaaaattagttggcatggtggcaggtgcctataattccagctacttgggaggctgaggtgggaggatcgctggaacccgggaggtggaggttgcagtgagctgaagaaacatcactgcactccagcctgggtgacagagtgagactctgtctcgaaaaacaaaaaaacaaagaagtttatggtggagaaagacagtttgttcctgttcgccccgttcctctcctctccagagagaggccccattagcattcgggtgaatttcccccaaaactttcccgtgtggattcccacataccccaacacttttgtttgcttgtttctttttcttttaacgtaagtggaatctacctgttatcctgtgaaaccttttctttaaccatgaggcacctttgcatctgtgtatagtaacagtcactgcctctaagggctgctgtgaggctcagatgagatcatgggtctcaagtgctgagcagagcaacttgccttagttgcattgtaagcgctcaataataacatttattttttggccaggcgcggtggctcacgcctgtaatcccagcactttgggaggccaaggcagatggatcacttgagcccaggagtttgagacgatcctgggcaacatggtgagacatcgtctctacaaaataaaaaataatactttttgttgttggcggtggtggtggggtttttttttgtttttttttttttgagacagaggagtcttgctgtgtcacccagactggagtgtagtggttttatcttggctcactgcaacctctgcctcccagattctagtgatcgtcgtgtctcaacctcccaagtagctgagattacaggctcccaccatcaggcccagctaatttttgtatttttagtagagccagggtttcaccatgttggtcaggctggtctcaaactcctgacctcaagtgttctgcccacctcggcctccctaagtgctgggattacaggtgtgagccactgcgccggcaacgctgtgattttatagcacgtccacaaaagggctgcatgtcttgcctaaaagttgcccggcgttttcttgttatgtgccgtctgcagtgcccctgagcttggccatgtgctctgcagcctggttcagcacctgtgtgtgccctggacggggaggtgcattccccgaggctaaaaccagtgaacctggcccaggccatatccagctgtgggcctcaggaaatgctgaactgaactacttttcaaaaggagggttgtgtgtccctgggcaagttaccgcccctctctgtgtctcagtctccttgtgtgtaaactggggataatgaaaggaccctcccacatggggttgctgtgaggattggatgagacactgcgatacagatgctgcttttatccttgccttcctgccggggtgggcagccagggtaactcacttttattgtcgtgtctgtccagagaagaccactcatttcattgactccatttataaatatttatttaaatttttttttatcaaaaagtaagttttattggcatctaaaaacaaaattcacccaacactgaaacatacttcaatatttatgttattgttttcttgtttcttttttactcactgcagtgtgaggaacaaatcacatttactttggagaaacagagaccatagtgtagattttacaaaatcactttttaaactctctgtattgcgctcctcaaatacctagagccagtctgtgcataacatggcacactgttgtctaaaccgtaaaattttgcatcagcctaaagatatggataagatatacctccacttgctcttttgaaatacatctattaccttatccagcctaatgatagttacctaaaaaattctttgttccgtaggaagtctctgacaagctgttattcatttccttgacgttaaaagaatctgggggcaacatttatattttatcagaaaaactttttaaaagtttacctatcatgttcatattgagaacaatgtctgtggcgggcatggtggctcacgcctgtaatcccagcactttgggaggtagaggtgggtggatcatgaggtcaggagttagagaccagcctggccaacatggtgaaaccacatctctactaaaaatacaaaaattagctgggtgtggtggcgggtgtctgtaatcccagctactcaggaggctgaggcaggagagtcgcttgaacctgggaggcaggggttgcagtgagctgagatcatgccattgcactccagcctgggcgacagagtgagactccatctcaaaaaaaaaagaacaatgtctatacaaatcagttgtacaattattttaaaagaatggtgagcatgaacgtcacgttaattctggcagacaaaaatgaacaactatggtccattgagccattatctgttacacagagatgacagctttacagaaggtatctctgacctactgagggatgatcatgtcctctcagtttctgtgccttctaccactagttcactttctatatcagcagctgtgtcactcttcttgtttatgttcataaatgtgtgttgaacacctactatgtgctctgagccctgggatacagcagtgaacaattagagcctgtcctcattgagtggatggtgcagtgggtgtgggagacagaatacactcaagcatgcgagccccaagagggctggggacaggcagtgccctgaaggagaaggcagtgcgggaggggacagagggacacagggctgagagggtgctctgtatcgaccagagatccacaggatgcaagggggtcatttggggaataacattccaggaagggcaaccccccagtgctgaggcctgggaggccaccttgggcagcagagtgagtgagaggggaggtcaggggagtcacagctttaccagatggactggaaattccttactctctcccttcactgcgatcgaaggcgccctggcaaatccaggagacagctccgcccagcagctggccccaggtgggccgagtggaattccggaactactgcctgcgctaccgagaggacctggacttcgttctcaggcacatcaatgtcacgatcaatgggggagaaaaggtgggtacacatcgccccattccctcacccattcccagtcgggcacagggtgccatcgggcaggtgaacctagctgcagcgtctccccagtcactcacggctccacacctttgcttgaatggctttttggggggctgggagtggactgtggcagtaaaagctgttcagagcgcatacagcttgcagaagtgaaggcttttaggtgaactgacagcctgaagaccaaatgagccccacagatttgttttggaagattttttgttgttgttgttgagagagggtcttgctctgttacccaggctagagtgcagtggtgtgatctcagcccactgcagcggcagcctcccaagtggggggactacacatggttgggagtgcaggtgtgtgccactgcacctggctaatttttgtattttttgtagagatgggggtcctactatgttgtccaggctgatctggaactcttgagctcaaccggtctgcccgcctcagcttcccaaagtgctgggattacaggaatcagccaccattcctggcccctggaagaagttctttttttgttttttggttggttgtttttttttttttttttttttttttttttgagatggagtcttactctgttgccaaggccagagtgcaggggcccgatctcagctcactgcaacttctgcctcctgggttcaagtgattctcctgccttagcctcccgagtagctgggactacaggcatgcgccaccatgcctagctaatttttgtgttattagtagagatggggttttgccatgttggccagggtggtcttgaactcctgacctcaactgatccacccgcctcagcctccccaagtgctgggattacaggtgtgagccactgcacctggcctggaagaaatttgaataagttgcaaatactgaaaaatctggaagacttaatataaaaatttattttctgctttttttggaagatcagaacatctggcaacatcaggtcaatcctcccccgcctggctctttctagtcaacctgtgagcctcctggttcaccccagtccctccctgtcccattcattgcctagttggcccctccaaaacattagaatttgtgatctctagaataaggtgtcaccatcccttctagggggatggctcaagggaagtgagaaattgtcagaattttggaaccttctcttggttccgagctgttcttggaagaggttccttgacctgagtgatacccttagactttcctctggaattggtctgacagtcttcctggccatttgctgggggacaaggctgctttcacctctgaacatatggacttattgaactgttcctacgtacctcccacaaagctcagaacattctgttcccagcagataatttctctctgagttacagagaagagcagagtgggtgatgttcttgctgtctttttttgtttttgtttttgtttttgtttttgttttgttttgttttgttttgagacagcctctcactctgtcacccaggctggagtccagtggtgctatttcggctcactgcaacctccgtcccctgggttcaagtgattctcctgcctccgtctcccgagtatctgggactacaggtgcatgccaccacgcccagctaatttttgtagttttagtagagatggggttttaccatgttggccaggctggtctcgaactcctgaccttctctgatccaccttcctcggcctcccaaagtgctgggactacaggcatgagccaccgtgccccagcccttgttgagtctttatggcttatctcacgtcatgagaatttttgcacgcatgctgctctgtgacacccctgtaggagggaagaaggagcccacttctcaagagccaggcaggaaggggagaactggaggtcaggaacatcatcctttggccattagctagagaacctagttccttcaagagaggatgcatggagaccaggtcatagcaaagggccggaagatctgcctgaatctttcagatatttcaacaactcatgatgggaaactcaccatcaaaggtgtgaaaaacagtggggaaatgaggaaatgcctgattattacttaatagtttcttgagtctaaacaaatagggctttgttggaaattccttctgcctcttctgtatctcttttgaggtctctagtaacttataaaaagccgagtcattccttttgggagcctggcaaagggaagagagtccttcttgaccttcggccgaaacacccttaaaggagtgtctctgggcagcgcgcaagggagagggctgtcgagttgggttgaccagatgactgatgcctgaggtggggccgagatgagggcactttggggcagggacaagtccggatgccagcattcccaccacacctgggcccttctgtcctgcaggtcggcatcgtggggcggacgggagctgggaagtcgtccctgaccctgggcttatttcggatcaacgagtctgccgaaggagagatcatcatcgatggcatcaacatcgccaagatcggcctgcacgacctccgcttcaagatcaccatcatcccccaggtggggtctgggtgtggcccagggggtgagccagagctggcaagccctatgattgcactgacagtggtgtatgtatatttttggggcaaacatacatttggccctacttcatcgttcttttttttttttttttttttttttttcctgaaacagggtctcgctctgttgcccagagtggagtgcgctggcgcaatctcagctcactgcaacctccgtctcccaggctcaagcgattctcccaccccagcctcctgagtagctgggactacaggcacatgccaccacacccagctaaatttgttttgtacttttttgtggagatggggttccactgtgttgcccaggctgcccttgaactcctgggctcaagcaatccacccaccttggcctccaaaagtgctgggattacaggcatgaggcaccgtggctggccttcattgtttttattgaagttaggctgtgctgctgcttccctgaatttcctcttagtatatgattaacaacgtgggaattaactgactatcagtcccgacttcctgtccccgggaggggtagtttcagagcatctagaaaaatccaaaaagacaccgtcttctctctctgctgccagagtcagactgagcatctctaacccttccaagagctagacaagaaataagactttttaattttcgattcacggggtgcacctgcaggcttgttacgtgggtatattgtgtgatgctgatgcttcggcttctatggatctcatcacccaactattgaacagagtacccgagagagagtagtttctcaaccattaccctcctccatctgtccccacttatggaggctccagtgtctatcatttccatctttacaaccatgagtacccagagtttagctccctcttacaagtgagaacacacagtatttggtgagaaataaggattttctttttctttctcttttcttttttttctttttttaactgagacggagtctcactctgtcacccagtgcagtggcacgatctcagcttactgcaacctgcacctcctgggttcaagcgattcttctgcctcagcttcccaagtagctgggattataggcacgcaccaccatgcgtggctagtttttgtatttttagtagaaacggggtttcaccatgttacccaggctggtctcaaactcctgacctcgagtgatctgcctgcctcggcctcccatagtgctgggattacaggggtgagccaacatgcttggctgaaataaggattttctagaccaatccccgcaggtggattccttaatatgttgccttttagtgtaatcttccctaaagtgtcttagaagattctcttctgtggttggatgacgggagaatccacgggactttactgttaggaatcacctgtgctgcgtctcatttctggaggttctcaacccacttgcatattgaaggctccaggaagttgtatggaaaggaaatctgttgtattctgccaaactcagactttccagacttttttttttttttccattattaaggcaattttttttttggagatagagtcttgctctggagtgcagtggcacaatcttggctcactgcaacttccgtctcccgggttcaagtgattctcctgcctcagtctcctgagtagctgggactacaggtatgcaccaccatgcccagctaatttttgtatttttactagagacagggtgttgccatgttggccaggctggtctcgaactcctgaccttaagtgatccactcgcctcggcctgccaaagtgctgggattacaggcgtgaaccaccgtacctggcctttttctccattattaacatctccagaaatagtgattccaaggagctctgataccccaccttcaacagtcctggccagaagtccttaggtcgcctccatccatgtcagcgtgacacaggtgtcacatgccgtccactctcttctctctgaacaggaccctgttttgttttcgggttccctccgaatgaacctggacccattcagccagtactcggatgaagaagtctggacgtccctggagctggcccacctgaaggacttcgtgtcagcccttcctgacaagctagaccatgaatgtgcagaaggcggggagaacctcaggtaggcgggggtgaacaaggagacaccgggtaaggtgtcctaggcgccatctcggtaggggtgtttgaagattctgtccagatctgtgtcacctggatttgagtcccagatgaccatttgtcccttcacctcttggagcctcagtttctgtatctgtaaaacgggtctcaatccaggctctttgtaccatgaggtagaataaccaggatgaccagtacatttccttttatacacaccagctccattcagttgatagtggctgtcagttgttaagctatggaaagtcttctgtaccagttggtcactagcactgctctgagcccccaggtccccatgcactaccccagctgtcttggtctctaccaggatcctggagctctgtccatgacccagcaactaaagcattaatgcctggcacaccagcggaacctctggggtcctgctttggtggtgtttgttagtgcctggttctggttctgttatccgtctccatgacaaccaaccataaagcctcaggcatgttcaaccataaagcaacgatcattgctgccatacgagggcagtcagccaggtggctctgctgatctcggctgggctcacatgcatgtctgggagtcagctggctgttggctgatctcggggtcagctggcttttggcctcaggtggggcaagaagggtatgttccgtgcatccctcattctccagcagaccagcttgggcatgttgtcatggcgatggcaggggcacaagagcgtgcaagcccctattgcatctaacagtattcttttggctgtccttacttttgctggtgtcccattggccaaagcaaggaacatgtctgattccagagccacctctcatggccccacagttggataagggatgcatgggtatgaggccttttttttttttttttttttttttttttgagacggagggtctcactctatcacccaggctggagtgcagtggcgcaatctcatctgcaacctccgcccccaggctcaagcaattgttctgcctctgcctcctaagtagctgggatgacaggtgcctgtcaccatgcccagttaaattttgcatttttagtagagatggggtatcaccacattgtccaggctagtctcaaactcctggcctcaagcgatccacccgccttagcctcacaaggtgctgggatactaggtgtgagccactgtgcccggctcttattttttttttattttattttttttaagagacagtgtctcactctgttgcctaggctggagtacagtggattgatctcggactctaactcctggactcaagcaatcctgcctcagcctcccagtaactgggactacaagagcatgccaccacacccagctaatttgtttatttttgtttttggagagatgggggtcttgcttttttgcccaggctggtctcaaattcctggcttcaagctatcctcccacctcagcctcccaaagtgctcagattgtaggtgtgagctgctgttttgagaatgattctgaacctgcatcttgctgaataggagatgtgctctgattgattagtgatgtctgctgcagacacagatgttgggagtggacatgctttcctggtcaagcaacatagagtgtctcctttcgcttctcccagcctgggcctaggttcagggtcaggggtggtttgacccaacactatctcctggtttttttcttccggtcaagtgtcgggcagcgccagcttgtgtgcctagcccgggccctgctgaggaagacgaagatccttgtgttggatgaggccacggcagccgtggacctggaaacggacgacctcatccagtccaccatccggacacagttcgaggactgcaccgtcctcaccatcgcccaccggctcaacaccatcatggactacacaaggtgatgccactggcacagtggcctctaggctttgggagtttgccttactcactggctcactcattaattcattaattcattcaacactgtccttatccctagtgacagccccagtgggtggatcctctcttcatcctggatggtaccagctatttctttttttttttttttttttgagacagagtctcgcttcatctctggagtgcagtggtgtgatctcggctcactgcaacctctgcctctggggttcaagcatttctcctgcctcagactcccgaatagctggaactacaggaatgtgccaccacgcccatctaacttttatatttttagtagtgacagggttttgccatgttggccaggctggtctcgaactcctgacctcaggcgatctgcccgcctccgcctcccaaattgctgggattacaggcatgaaccgctgtgcccagtggtaccaggtatttctaatatcatctagtcattcattcacgtcagcgcacctgcggtgttcccagacactggggactctgtaggctgctgtcagacaaagtccctgcctccaggaccaagtagcttattagatggaggagacaaaaaatatacagagcaataaaccaacaggattccagagggcagcaggtgctgggaaggacgcttgccaaggagacgggatagcgagtgctgggcagggccactgtttccattgaacactgcaggcccagtgcgtggggcccacaaaaaggttttattttttttaaaaaatcagaagcaggccaggtgcggtggctcacggctgtaatcccagcactttgggaggccgaggcaggcagatcacctgaggtcgatagtttgagaccagcttggccaacacggtgagaccctgtcaccattaaaaatacaaaaagtagccaagtgtggtggtgcgtgcccataatcccaggtacttgggaggctgaggaaggagaattgcttgaacctgggaggtggaggttgcagtgagctgagattgtgccactgcagtccagcctgggcaacagagtgagactccatctcaaaaaaaaaaaaaaaaaaaaaaagaatataatccaacctggattttatttatactaacacagtcataaaatagaatttctagcattttgtgtggagaaagccacctccgtaggcatcagtgccggggaccacaaaagtcagaatgctgccatagtgccagggtcctggggggttttgagttttgtgtgggtcatctctgaagaggtgacattttagctgagacctgaacaatgaaaaggagtcagccttgagaagatctgggacagcgatctgcaaccttgttcttaagggccggggtagtttcagctttgtgggccacatggcctctcagccacttgactccagtgttgccgtgtgaaagcagtcatagatagtgcacgaatgaatgagcatggctatgttccaataaaactttattcataaaaacaggcaaggggtcagatttggcctgcaggccacagtttgccaaccttggatctaaaggaagaacattctaggcagccggtacagccgaatgtaaaaatgaatgcgcttaatgaatttgaaggctagcatgaggaggccatgtacctagaggttggaattgagtggacaggggcaggagattaggccagaaaggtaggcaggggctggatcttagagcaccatgtaaccacggtgagaagcttggaacttactctaagagccctataaagccattggaaggttttaagcagggaagtgacatgagtttctattttattttatatatttttgagacagggtctcaccctgtcgcccaggctggagtgcagtggtgggatcacagctcactgcggcctcaagtgatcctcctgcctcagccttccaaagtgctgggattataggcgtgagtctctgcacccagctgacatgatgtttctagttcactgagtaccacctactaagtggcagatgctgagttggtgcttttgaaatataggacatagaaatgaggacagaagtgggcagtgtcaaatcttacaggacctaaaatattaggggtcagccaactatggcccacaggccacagatctggccccctgcgtgtttttatgaataaagttttattggcacgcagccacatctgttcattttcctgttgtctctggcagctttcacactataaatacagcagagatgcgtagttgtaacagaaagcatatggcctgcagagcctcaagtatttactatctggcctttttcagaaaaatgttgccaatcgttattgtagactgtggtaagatctttttattttactctgaatgtaatggaacagtgaatgtgaacagtcaacactgttaataccattcacaccatgattgatgtggggtagatattaaggagctggcctcatgggaatctgacattgactagaaatagggattgagggtgagcaaccagctggaaggtactgcaccagtcctagcaaaaagtgttaggggcctgacccgaagcagtgacttgcccaggtcagttgtcccaggggcacgaggtgctcacccctccccttcccctcatgtctgtatcccctctccctcagggtgatcgtcttggacaaaggagaaatccaggagtacggcgccccatcggacctcctgcagcagagaggtcttttctacagcatggccaaagacgccggcttggtgtgagccccagagctggcatatctggtcagaactgcagggcctatatgccagcgcccagggaggagtcagtacccctggtaaaccaagcctcccacactgaaaccaaaacataaaaaccaaacccagacaaccaaaacatattcaaagcagcagccaccgccatccggtcccctgcctggaactggctgtgaagacccaggagagacagagatgcgaaccacccaaaacacgcacaccctgcccctggtgccctgagacagacacacagcctcacgcccccaggaatgcaagtggtttcctggtgcttcccacggaggagttttggcagccagacttctggaggaattggttgtatagaagatcctagtgaccaaattcagcctactgcctcggatctctccagccgaagtctgtggactgcaagtctttgagatgcttctggctcccatcacctctaacatccttgtctgggtctaccaggaacgcttcatttccttggggctgcagttttgtggttgaggggcctggagaaaatcattttctccccttggcagtgtcccagggccctggatggtcctcttaccaacatctggtcttccaggcactcaaaagctgggaaccagcatctcagcgccagctctaccagttctcgttttgggccagaggcagcctctgcactcccacgcctgtcctcctggaagggacctggttggactaacggctaacctggacctggaactgtagggccaggggattgtctcagggccgacgttccacctggggcttccctccccacccaccccgactccaggctttcccttttttcttttgttcaacattgtaagaacaatcaatgctgttattactgttcccaccatgattgatgtggggtaaatattaaggagatggcctcatgggaatttgaccttgactagaaatagagactgagagtgagcaaccagctggaaggtactatgccagtcctagcagaaaaatgtgttaggggcctggcccaaagcagtgttggttgcttacagtgttgattgattttgttcttttttcttaccacctcttttctttccctctcatggtacctgctcatggttatgaagctttcaaagtaaagaacacgaaatacctcccaagtattaccagtgggtaccaaaaaaatgtccccttgagtcttttccttgtttttagatgttaattctctcccttggcatccggttagccccccagggggggcagcattgtggagaacttgatatttagttactgatgctcttccaggacacgaaaagaacccatctttgaatatcaatgattttttttttttaagtactgttccggggagaaaaacagtctcaaaacttgaacttcttgggaatagaagtgttgggctgagaagtaacattcccaggaaatagtgagaagctcgccctgtgtttgaaaccgtgttggtctctgtgttcctggaagaaaacagggaagcagcatcttttaaagcctgttctttaaggtgtctcgttagagcccaaagtggaatccggaaggcagccagagctgaggctgccccaagactcagacttgctaagaattacgccgccgacttcaaacccagagagcatctttcttttaggcgaaaacgcatatatttattttttgtaagttataccattctttcacattagataaactaagttttgggggatccttttgtaatgacttacactggaaatgcgaacatttgcagtaaaaaaatatatatatatctatatattttatttctttctaaagaatggttccctttcctttggggcctcggcgagggttccagccatgtcctctgcagggtcaggatgtggcatcttcctgtttctgttctttccttttgacaacaagtcgcctctagtgggagctgttgccagaaagggcaagttgtagagatcactagtcagatggggtttagtgggaaggcgggacagccgcaaggtggacggagcccaggttttggggttggacagaccctggcttgagtcctgctcttgtcatttgctgttcttgtgaccctggggaagtcactcagcctctgtgcctcacttgctttgtctgtaaaatgaggctgatcgtacttaccctgtgagcagtgatgtgtgcggtactcgtagcctcggtcaggttctaagacacaggcgaggcagaaatcacatgtggccagaacgatccttgaaaatcctgccctccccctgcccttttttttttttttttttttgctagaggcacggtctcactctgttgcccaggctggtgtgcagtggcacgatcatagctcactgcagcctcaaactcctgggcttacgcaatcttcctgcctcagcctcctgggtagctgggactacaggcatgtgcccagctaatttttaaaaatttttatagagtcagggtcttgctatgttacccaggttgttcttaaactcctgggctctggggatcctcctgcctgagcctcccaaagtgctggggttcaggcacctggcctgaaaatccctttatgttagtccagagaggcgaggctgcgctgcagtaacaaattcgccgtaaaatcttcggaaatgatcacaaggctttatttcttgctcacgcagttcttggtgagggtcagctgcctctccagggtaggtgacttccctgtgacaagtgatccaggctgtcctggttttgtgacatggcctcccaagggttggcctccaggtccccacagtgggagaagggagagtggacgactctcacccactcttctgtgtctgaaaccggaactgacgcagttaatcccactcacagcccattggccaaaatgagtcacatggccccaacccaaccactgcgggagctgggaaatggagcggtgcctgtggaagagaaggatttctccctttcctaactgatgtggttctggagttttggatagcggagtagtcagactagtgtgttcggtttctaacttcgaactgggtgagtctgggcagtaaggaatgtctgtatttggggagcacaccatttctgccacacctaaaaccatgcaccaagtacatgtgcagatagaacgttctagcactgccattgttccctcaagctttcctgtcccctgattgaaattgttggcttgcactagggactgtggtgtacaaaggtgctcagggaagagccggcgaggtggtgaccattagaatgagtagtagtgtctgggtgcagtgactcatgccccattgaaactgttggcttgcattagggactgcagagtgtgaaggtgcctagtgaaaagccagtaaggtcataaccattagaataggtagtatcagccagccgggcatggtggctcatgcctgaatgatgtcattggcttgcattaggaaccacagagtatgaaggtgcccagtgaaaaactggtgacgttgtgactattagaattagcagtattggctagacgaggtggctcatgcctgtaatcccagcactttgagaggctgagacaggaggactgcttgagctgaagagttcaaaaccagcctaggcaacatagtggaactctttctatataaaaactttttttttgttaaattagaagtagttgaggctgggtgcagtggctgacgcctgtaatcccaggactttgggaggctgaggcgggtggattgcctgaggtcaggagttcaagaccagcctgatcaacatggtgaaaccccgtctctactaaaaacacaaaaattagttgggcatggtggcacatgcctgtagt

SEQ ID NO: 28 - DNA, 57476 bp, homo sapiens
cgggggcagggagaccggacccagaggcactggggtagggctcggcagggcgggtccgggcggagcgcggggtgcggagggcggaggcggctccggcgcccgctctgcccgccgctgggtccgaccgcgctcgccttccttgcagccgcgcctcggccccatggacgccctgtgcggttccggggagctcggctccaagttctgggtaaggcgcggggctccggggtcactgcgcgggggccagggtcggccggcttcgcccggtccccgccgcctgccttcccgcggggccggcaggtatcccgggacggagcccctgagacggcctgggcgcccgggagggggcgatgggctcgggagggaggttggctgcgccgcccggagccgggtcccacgcggtgtcggggacctgccctgctctgcccttcccggctgcagcactggggagcccgggaaagtgaggaagagtgcgcggctggggcgcaaaggcacagtgcgtggctgggtgagtcggctccatcccagcccctccgtcgggtgcggaaggggcgtttcgcaatcagccgcgggttcctgatggagggtcttccctcagcatctgcctcaggttaggactcggttgcccacctgggcatggattgcccccagggcatccagagcacctgctcaaccaggtgttttgggaggccggctgtgcagtgtcccacccttcttaggaaggtttcctgccaccttcttttctctaggtaagactgaggtctgagagcaggccatccccaccactccggactcagaagggagaagcagaccccagtctggagacaggtgcagggtgtcaggattcctgtagtccaactcccttctcacagatggagaaagggaggcccagagagaggaagggacttgcccaaagttacccagttcaatgaaggcagagctgggatagaaaaacaggctacaggccaggtgcagtggttcacgcctgtaatcccaccctttgggaggcagaggtgggaggatcacttcagcccaggagttttagattactgtgagctatgatcgcaccactgcactgtggcctgggcgaaagagtgagaccctgtctctaaaaaaataaataaataagaaaagaaaatcaagcctttggtgactctcactccaaatctctttctaagacaggctgctcttcagcctgctgactccagcctccagcacagttcaggtgagctaagtgcatacagcctaggagctttcttaccaacttgcaaaacttacttgcctctatgaggcaagtgatcatgtggtctccgttttacagagggagctcagattaaaggtgcttctctgtggtcattaaaggggtgtccagggcttgtgaatcccaatctctaagtcttttcctattttgagtatttgtacatatatgccctttgtgtgtgtacgcacacacgcaggcacgtggggtgttacccaagagttcgtgctgtgcacgtgtgtgcacaggtgtataagtctggagctatgctcttgggctgtgtttagaatgggctgaaggcgttatatggattttttgaaacttggggcaatggaggtaaaaaaaaaaactgtaaaaaggcatatttgggattctctctttttctgtgggtgacccaaaggttaatccgagatggtgcaacttctctgccactgcccttctttcccagtcccacaggaacttcatgtattattcagcatggacaggccacttgccaccagggtccagaggttgtgcctttgcctcatgagcacacttcctttcactgccctttgggccaggctggtatgaccgtggcaggtttgtggtgcctgggatgccaaacagaaaatcaagagggtagttgtgcccaagcttcaggcacaagggctcattgttcctgggtagcctcctgaaccctgagagcttaggactctacagagacaggtctcctggaccccagagttgggaaattcaggactccctttttgtcccatgttcagacatcctctggctctaccttaacatgggattgtggaatccaagaaagtgggagcttgggagtttgaagcagcgagtccaacccctcagtgtagagctggggaaactgaggccaagggagtgaaggtcacaggacaatcaaagacagagtgctgggctgggaaaccggaccccggggctgtggttacagggttgccattgcctggctgtgagcctttgagcctctgggccctctggcccgcgcacttctccttgatgctcgtgagctatacacacctcctctgaggatgcaggctcagtgggagtcagctcatctacattatgaagccctcgtgagatctctgcttggataccttaaatggcaaactgaccaccccccttcccaccccaatctctaaacatctttcacattctcttctggctcctgaaagctgttccaggctgcacccagtgtggctggtgactggggaaggagcgtggagagagaaaggaggctcccagctcatcctctgagggaatgacagggtttgtacagctgaaaggagagagagtctacactggaagctggatcctctgccacagcctaattacaaaaaaggcctggagttctgggctgttcatttgtgatgtgctgtgttgcatctcatttgcatggtgtattattaaggcacaactccccctgaacctttaccttaggggcctgtgggtgacccactttgtgggaagtggttcagggcagcccggaagtacctgaactaggagtgaaaatgcaaggagggggtggggtgttcaggcccctctgggccgctcatttaatctaccaagatgctcagtagctcatccttatagcttcagtttctccaccagtggaatgggaaataacccaacccctacccacctcacaagatttttctgatcaaatgagacagggaatgtggaatgattttaagaactaagaagttttctatgggtggcaagttctgacattccccggaagagggaggagaaagaaaaatggggttagaagaaaatgtcagacgtgggaagacctgcagggaaagagctggtagggctgtcgggccagtggctcccatttcagctgtttgctggggagctgggagctgttcctggctcagtctgagggtaggagactggagaggaccatgccccttgggacatgtgtacacacatctgtgtactcacacaccacctgccaggtgaatgatttgtgtgaatccttctctctctcacccatatcgactttgaagcaggttaccaacttccctgaatgtgccttgggagtttttgtggaaataaattccaaaagagtgaactgtgtaattaaaccacctcactactcaggaggccagaggtgcctcagaacaagggaggaggtgggatcctctgcctgcaggattcctctctgttctgaaccacagaggttgggagcacctgggtggtgaagggagtatgtggaggaagggcctggaggtatttaccccccgccagataaacacctgttggcagaattagccttgatctgacagccccaggaagcttagaaatctgaagatcctgaccatgaaagccatccaaagatggcaaggaccgcctgagaagtagtgagctccctgtcactggggggtatgtaaggacatggttagtgactgcttggcggagatgctggagagaggattcaagccaggaaagaaggtggggtcctgagattctgtgactgggtagagggaagatgcggccagtggggattcattagttcctcctctgagatttctggactcctccttccctggctctctccctgctctacatacggaatttgcctagaagcagctcttggtagaggcctctgggtctccccttggttaggcccacatgggaaaggtgacctcattgttcccttagctgtttacccatcctagggaggggcagatccctggtcccttggaggctcagctccctgtgtctcctgctctgttttagctagccccaattctgctattcaccagctgtgtgactttgggcaaatgactcaccttctctgggctccagcagggctgaggtgggctctggggcctgcttcaggtctggagttgcccaattttggaaggatgagccttgggcttgggggcgaaggctatgcatgattagggcccttcaaagcttagagctcctgggtatcagggtctcctctgccttcttagtaggcagccacaaaaatgtatgagtaatgggcaaggctcctatgccaatgtattttgactcacaaatgaagacagtgtcctgcacatccatggggaagctgagtgggaggtagacactcctccgcttagcagacaccatagctcaccctcccctcaggaacccagtcctccctgcaaggccagagctcccggggctcctttcctccatctcagctgctgcaagcaaacccagtgctggatggctttgacctctgagctcttggcttctggctacggcatttcattgcttgtggcctcaggctggcttctcctcaatcctgctgttcccccacttcacctgggccttaggtccctgagggccagagagatacggggaaggaagtgagtcagggaagtggcattcaggagggagctttgccaagcccgcctgtagtccccagacagggaaatggtcttgaaacactgggcaggcttccagggaggaaggacttggcagggatgaccagctgagccaccccggagtagggccagagcacccggactgtattcagtcctctccattggggcaggatccctggggagttgggggtgaaatgagacctggtatgccattgctggggtggctgggcccctccccttcccgaactgaagttgtttctgtttctggtactgcggtgcagtggttggggctggcagggggcagggtgggatagtgaatgagagcctaactctaggcttggattttggatttctccttttttttttttttgtgacagagtcttgctctgtcgcccaggctgaagtgcagtagcacaatctcaactcactgcaacctccacctcccaggttcaagcaatcctcctgcctcagcctcccaagtagctgggattacaggtgcacaccaccatgcccggctaatttttgtatttttagtagagacggggtttcaccatgatggccaggctggtctcaaattcctgacctcaagtcatctgcccacctcagcctcctaaagtgctgggattacaggcgtgagccaccgcattcagccagatttctcctaactggatattcaggtttctagtcaggggctcccagaaccccagctaggccactacccaggtgttagccgctctgctccctcagctctgtgagaataattgcaaaaagcaggtgatatgagaatgggctgcatggctgaaaggtgatctgggtgcaagtgctctatccccagggtgggacatcatgccggagtcctaccaggtgtacaggaaacactaatcctgtgggaaggagctgggccctggaacaaaactctctgggtctaatcccagcatcagccctgggtgtcagctgtcatgagcgtgaaatgatcatcctggcccacagcaggagctcagtgaaccaaagccccttccagaagcacattggccagttgagcccgtgagccatccctgcaaggggccagcaggcgcagcacaaccagtttttgtttgtttgtttgttgtgttgtgttgtgtttttgagaaggagtctcgctctgccaccctggctggagtgcagtggcgtgatctcagctcactgcaacctccgcctcccaggttcaaacaattatcctgcctcagcctcctgagtagctgggattacaggcatgcgccaccatgcctagataatttttttaaatatttttagtagagacagcgtttcgtcatgttggccaggctggtcgcagactcctgacctcaggggacccaccctcctcggcctcccaaagtgctgggattacagcacagccagtttttgacccctgcccccaggccttccaaaggctgagggagggtgagtggggatcagcacgtgtccttgctctctccacgccttcattgctgctgagtcaatggtcttgtctgttcatcccttccctatctgggacttcaggagctgccctgcagtggtggcttccttctccagtaccacacaggaatagggaagtaatgactcttctcatgacagagactgtcaacaggcctggggcccccagggcttgggaagtccctggcaaagctggggcagagggctccggggtcctcaccccccgcccccatcgcctgtatgagtctgcagtgatttcagcttcagtgaccatgaagtctgccatgagggggcctctgccacgtggtccattctggatgtgggaccttaccccttatcagccccatccagctgtttaatcgcattattaaggaagctgttgttgctgtggaaactgtgtgggtgatggtgggggagggggctgtgggctcagctctcacctcccagcagtgctcttcagagcgggaatgagaggagagccttgagtagggatcgtcatcctgccctgcagggattcagggagtgttacagggtccagggaataaccttcactggccctgtcctcaccttcattttacacataactgagttggagacccttctgggtgccaagaactgtggccttggtaccagggagagaacactgtgttcctgggcatgaagctgcagaggctgcggctggagttggcaccctccatttatctattcatttgtttattcattcttttgttcaatagatggttattgagtaccttctctgtgccaggccctgctctaagcaacaggaaataccatcaactgcagaatacagagctaaagaatctgtcttcgtggagcatatactctagtgggaagaggcagtaaaacaagaatcataaaggccaggtgcagtggctcatgcctgtaatcccagcactttgggaggccgaagcaggaggatcacttgagcccagaagttcgagaccagtctgggccacatagtgggaccccatctctacaaaaaaattaaaaaattagctgggcgtggtggcacatgcctgtagtcccagctactcaggaggctgaggcaggaggatcgcttgagcccaagaggtcaagattacagtggggaaaaaaaaaaaaaaagaacagttgaatgtggcactgtcatgccgttcaacctgtaatttgaaggtagaatggacagggtttgctgagagaccggatgtgggatgtgagagaaagagaagaatcaggggcaactccaaggactctggtctgggaagagagacaggaggaaggaactgccatccccgggccaggcaggctagaaaggcagggacggccaagagctcagttctggacgtgttttgtatgacgtgtcccatagttgatgtcctagctcagggtctggagtgaaccaaatagggagttaggggtgagggcctgtgtgggcgggtaccccctgcctcctagggagggccctgcccaggtgggacatgcttatctcaaggaaaggagcccaggctgaatgcccttgagggtcaaagcagccacccagttctcacagccccaaagtcccctggttgttgccacagagcaggtgtctgcgaaaccaaaacacgggcctgacagctggaggctccatcacccgcttccctgagtgttgtcccgttgccatcgaagtgctttgctgttcattctccctcaccttctccccgctgtggggaggtgaccagatgctgtcatcactcccattactcacaggtggagactgaggttcaagggcacgaaggggctcaccaacagttgcatggctcaaaagtggcagaagccatcctggattctccgcatcggggttgggttcttcctgtggccactccccacccgccttacagagccatgccaccggcctgcaagtgcacacagcgattcccaccatgtccccacgcctgggctcctgtcctcaacatgcacactcccttgtgagtcaatggccccgtgtggcatcacaaagcctgggtgcctgtcccggccacacactgctgggtgtccttgaacctgttgccaaagtgggtgtagtttctcttttgtacactgggcctaacagtgcccctcctatatacccctggaagttgttctgagacaacatccagataacaactaggtaagtgcagtaataaaatgcgggagaaacattaggggcctttattttcctcacttaactggctgccagggaaaagcaaggaaaggtcagaggctggggtgccccagagaggccccatgtagatgaggctctggctgggcccagagaaatgggatgtacactccggcccagagacctgaagatctgggttcagggcagctttgggacaggctatctggatggcaactaactggagtacctgatcaggcctagaggtgtgtcctgtgacccagtgtccaggcctgggccagcatgtcagagactcagcaagagtatgtgggtccttggctcacattgtttgagcaactactgaatactgaataggactactgaatactgaatactgaataggacaagatgtacatggtacaacttctgcccacctgggccttcaatgaaatgcccccaggcagcatgtccctgactgcatgcttcacagagcagggataggcctgcccaacgtgccactgtatctgcagaacccagcccactgcctgactcaccaaggccctcaccaaacattgtcaaggccaagagtgacgctccagggaaggggatctctctaggaggaagggtgctcaagatgaagaaggtgggttttcagccaggcctgtcacccctccctggagtggttaggttaggattttgacaagtggtaaaaagagggactaggttgagcaagggggtaggagcaagaatctcagagcagatttaggatgaagtgagttggctgtgggggaagggagcaatgggaaaggaggtgggaggagatgccatggggggggtcttgaggaccaggttgggtgctaggatgtggcttcatgagcagcaggagtcactgcaggtttgtgggcatgaggcaagaggcacaaagctgtattttgggaagagccatctcgcaggtgggcaggggcactggagggcagagggctgccccagatgggattaagaagggaaggcaggccaggcacagtggctcacgcctgaaatcctggcactttgggaggctgaggcgggcggatcacaaggtcaggagttcgagaccagcctgaccaacacggtgaaaccccgtctctactaaaaatacaaaaattagctgggcgtggtggcgggcatctgtaatcccagctactcaggaggctgaggcaggagaatcatttgaacccgggaggtggaggttgcagtgagccaaggtcacaccactgcactccagcctgggtgacagagccagactccgtctcaaaaaaaaaaaaaaaaaaaaaaggaagaagggaaggcaggctggggaggttggggaaaggaagcagggagtgcagatcactccccttccatgagttgttttcttaagatgctagaacttggccaggcatggtggctcacccctgtaatcccagcactttgggaggctgaggctggcagatcacttgaggtcaggagttccagaccagcctggccaacatggtgaaaccccatctctactaataatacaaaatttagctgggtgtggtggtgtgcacctgtggtcctagctacttgggaggctgagacaggagaatcacttgaaccctggaggcacaggttgcagagagctgagatcgtgccactgcactccagccgaggtgacagagtgagactccgtctcaaaaccaaaacaaaacaaaaaccaaggccgggtgcagtggctcatgcctgtaatcccagcactttgggaggccgaggtgggcagatcacaaggtcaggagatcgagaccatcctcgctaacacggtaaaaccccgtctctactaaaaatacaaaaaattagacgggcatggtggcgggcgcctgtagtctcagccaatcaggaggctgaggcaggagaatggcgtgaacccgggaggcggagcttgcagtgagccgagatcacgccactgcactccagcctgggcgacagagcgagactccgtctcaaaaacaagcaaacaaaaaaacagaaaacaaaaattagcctggcgtagtggcatgtgcctgtaattccagctacccaggaggctgaggtgggagaatcgcttgaaccctggaggcagaggttgcagtgagccaaggtcgcaccactgcactccagcctgggtgacagagcgagacttggccttaaaaaaaaaaaaaaaagaaagaaattaaccagccgtggtggtgcacgcccgtaatcccagctactcagaaggctgaggcacgagaatcacttgaacacgggaggcagaggttgcagtaagccaagattgtgccactgccctccagcctgggcgacagagcaagattccatcaaaaaaaaaaaaaaaaaaaaaaaaaaaagatgggagaactcagaactcaagcatatagattattcaacagttcacatagccagatagttcaaggccagctgtgggctttgaatgccatagtaaaatgtttgaactttgccttctaggcagtagggagctactgaaagtttaaagggatggtatactattattctttcattcatttattcaataaacgtgtatgtgtgtgtgtgtattttttttttaagagtccaggtcttgctctgttgctcaggctagagtggagtggcataatcatggctcactgcagcaacaaactcccgggctcaagagatcctcccgccttagcctccatgtaactgggactacaggtgcctgtcaccagaccaggctaatgttttacatttttgtagagacagcgtcttgctatgttgcccaggctggtctcaaactcctggcctcaagtgatgctcctgccttggcctctcaaagcactgggcaatgtccctggtcttcaataaatatttgatttatttaagcaaatcttttttctgagcacctactatgtgctaggcaccattctaagtacttaggatacatagataaataaaataaaggttcttcccttcaaagagcttacatgtcagcaagtaaaggaaaagatgagagaaaatataataaatcagtaaattatatatcatgtcaaaaggtgataggtgttatagagaaaagaaaaagcggagaagggtgggagaattgggaatacaggggtgggacacaggtggcagtattaaacaggatggtcagggtaggcttcattgagaaagaaagacttcaggatgtctgggggaggagtgttccaggaagagagaagagcaagtgcaaaggccctgagacaggagcagcaagtgcatttagaaacagcaaggaggccagtggctggagtgaagcaggaaaggcggggagagggtcatgggttgggggaagggacattgtgcaggtctatgcaggctattgtagggtgtatggagtgaagatgtcaagtcagcagttagatatggagctggagatttggggagcaatgagctggagagatagacttgaaagtcattggcatatagatggtacatcatatcatcatatgagactgcatgggattgccaagaggttgagtgcagataggaaggaggcagagaagaggaaaggactgagctccaggaccctcttgcaccaggcaggggaatcagcaaagagactgtgatggcatggccagaaaggaaggggaaaaccatgcaggatctgggaccccagggaatctgaagggaagagaccagaagtctatggcaattgctcatgaagagatgagggtctggccaaggggccaggtgggaggaaccaggtaagagatattatcatcccaatgttacccttaaagaaaccaaggcccagagaggggagaggttaagaacctgggtcaagatcacacagcttaagtgtgacttcttctttttattttttatttttttgagacggagtctccctctgtcaccaggctggagtgcagtggcacaatctcagctcactgcaacctccgcctcccgggttcaaacagttcacctgcctcagcctcccgagtagctgggattacaggtgcctgccaccacgcccagctaatttttgtatttttagtagagacgggatttcaccatgttggtcaggctggtctcgaactcctgacctcgtgatcttcccacctcagcctcccaaagagctgggattacaggtgtaagccattgtgcccggccaagtgtgagttcttttaagctgtgtgaccttggccaaggtgcttaacctttccctgccaagtctcaaacacctctttgtccagctactatgcttccatcaagaatcaataggacctatgtccctacaggtgtcagggtagctggcagaatggtgatgcccttggcagaggcaggcaaggccaaaggaagggctggttctggcagggagtgaaggatcttactttgagaggtattgaatatgaggtggctgcagacagatggtgacgccatctgagaggcagcaggaagtaggcgctgaggctcaggaggtgatttgagctgttgatctggatttgggactcctcaggacaatctgtgaacaatgatgagagagagcaccaaggaccaaggtctgaacttgggagctagggcccatgtccacagggtgaactggaaggaagataaggagacagcaaggaatgcttgccaagaaaccaggagaccaggaaagagtagtttccaagagatgggggaagcccacactgttgcagggaggtcctgcataaagtctgaaacgggtctatttaattcgcccttggaggctgggcatggtgtctcacacctgtaatcccagcactttgggaggccaaggcgggtggatgacctgaggtcaagagtttgagaaccagcctggtcaacatggcaaaaccccgtctgtactaaaaatacaaaaattggccgggcgtggtggtggaagcctgtaatcccagctactcgggaggctgaggcaggagaatcacctgaatcccagaggcggaggttgctgtgagctgagatcacaccactgcacaccagcctgggagacagagcaagactctgcccaaaagaaaaaaaaaaattgtagttggaaggacttctggttctatagggtggattgaacacaagactttatctccagtccttcctgattttccatcaaagtgacagtaaggaataaagaatgtaaacctacaaggacaaagagaagaggagacaacagcagacaagatattaacacctttttggaaagtgagaaacaggttgaggagtgatcactgacacagcagagaacaactgaaaccaaaggccatttggagtctgtaaaagctcggggattggagggctgaaggaggcaaggggaagagcagggctgaaagcagcggctgctaggagaatgcataaggagagatgaaacacccaagatacttatccatctcctctcaaagccaggcaaattccagccacctcacagaagaccagcagtttattctgtggaattaagtaaaagtctgcatactgaaggatagaaccctcagccctcactcctaaattggtcccagagaaaagacctccagattcttccagttgttgggggagtcttccctaaaggaccaggttcctacttgatcactctgcagtgaagcccaacagccaataagcttggtcctcggtactctgtcttcagtagctgtttcttggtccttggtccttggtactctcactcatcattgttcacagattgccctgaggagtcccagatccagtcccaaatccacctgcccccaacacacagagcagccaactctttagtgtcttactccaaaatattgagacagccaagccgcaagaatcaccacaggtcgggtgcagtgactcacgcctgtaatcccagcactttgggaggccgaggcaggcggatcacttgaagtcaggagttcgagaccagcctggccaacatggcaaaacccctctactaaaaatacaaaaattagctgggcattgtgacacgtgcctgtaatcccagctactcgggaggctgaggcaggagaatttcttgaacctcagaggcagaggttgcagtgagctgagatcgtactaccacactccagcctgggcgacagagggagactccatctcaaaaaaaaaaaaaaaaagtcaccacacatttgaggaaaaattctgttaaaataaaaactttagacaaattaaatttagcagagtttatctgagcaaagaacaattcatgaatcagccagcatcctgaaccagtagaggttcacagagttttaccacccagcagtatgggcaggcagtattaatggacagagaaaggaattgatgtatagaaacagcttgattggcgacagatcagtatttgccttatttgggcatggtgcaatgaggtgtttgccttatgtggacatgttctgatgatctggcagcttgtgattggctgaaaattctgctatatttggctgagacttggctgcttattgtaagaatatactctcaagttacgttgcagtttgtttacatattgaattatgctacagtccactatgtatggagtcagctttatacctgggtgacagagtgagactttgtcaaaaaaagaaggagaggagaggagagagaggagagagatgaggggtggggaggggaagggaggaaaggagaaaggaaggaaggaaagaaggaagggagggagggaagggaaggagggagggaagaagggaaagaaagaaggaaggaaggaaggaagaaagagagagagagaaaggaaggaaggaaggaaataggcaacacataaaataaatttttttaataggatcacaggtcactgtgaacaatagccgttcattaaatgacttcggaggcatatacaaaaagttacatagttgtagaaaaagcttagctgttttaatagcgagttctcagttttcttaagtgatcaaaaacctaacaaagacagcatgaagcacaggaaattatctgggtagaacacagaatctttgttttctaggccaactacctaaagagaaagaaaaacattttacaatttcctattatgatcagaccaataatctaagaacaccatgttgttttaatggagagaaccaaattctagttttgcatcagtgtaattttgatattaatgctagctcttatcgcccaggctggagtgcaatggtgcaatctctgcttactgcaacctccgcctcccgggttcaagtgattctcctgcctcagcctctcaagtagctgggattacaggcgcctgccaccacacccggcttattttttgtatttttagtagagatggggtttcaccatgttggccaggctgggctcgaactcctgacctcaagtgatccacccgcctctgcctcccaaagtcctgggattacaggcgtgagccactgcacccggtcgctaacttttattcttaaaaaacttgtaaataattacctcctaatcttaaccagcttgatcacccataaaatttctttcacaagattcatcttccacaaacctcctacaactcttatatccattcactttttgtcctatactttcctcttctcattttcgaaaaatcagtcatttcactttaggacaaaatttattctctttttccgttatcaaaacaaaacatcctcacgtcttatagcttttccttagcttcctttgtatatttctttttcatatattcctttttcttaccttccttgtatattttcatatagattttcccccttattgtttctagtaattgtagctacatatattaattagaattcttaaccccggccaggtacagtggctcatgcctgtaatcccagcactttggagtccgaggtaggcagatcacttgagggcagaagttcaagaccggcctggctgacatgctgaaaccctgtctctattaaaaatacaaaaattggctgggcgtggtggcgggcacctgtaatcccagctactggggaggctcaggcaggagaattacctgaacccaggaggtggaggttgcagtgagtcaagattgagccactgcactccagcctgggtgacagcgcgagactccatctcagaaaaaaaaaaaaaaaaaaagaattcttaacccttagtgaccttaatttccatggacattagaaagtaagcatttgtgaattgtgtgtcacaccagctgtagattggtaaatctatgaaccataatgtctagaagcatgagctttctcatagtacaatttgtcagtgtggcacagaacatgtttctcaatggtccaaaatgtctttaagtctctctgtaaaaataaactgtaaaggaggcaaaatttcatttgtatccctttaggttttttgtttgtttgttttgtgaggcctgaaaactaaattgttgtttgtacagatttccctcctcctcaactttctattcttgatgctaagagtgttaaaaccttctggtggctgagcgtggtggctcacgcctgtaatcctagcactttgggaggctgaggcaggtggaacacttgacctcaggatttcgagaccagcctgggcaacatggtgaaaccccatctctacaaaaaatacaaaaattagctggatgtggtagcttgtgtctgtagtcccagatactttggcggggctgaggcgggaggattgcttgagcccaggaggcagaggttgcagtgagccgagatcttgccacttgcactccagagtaggcgatagagaccctatttcaaaaaagtaataataaaaccttctggtataggaaggacatcttttacatgggaattttatcttacattcatttaactcacttattttcaacacttatgcttggattgcctataaagatgagataataaacaactagtcatcattttgtttttcttgctgacaaattttataatataaagacaacataagcttgttttaccagtaaacctagataggaaatcatgcatctttatgatatttaatccccaaaactatgaaaacatgtctgtttcagtcaaaccaacaatattcttatttgccaaagattacccaagtcagatgagctgcaaaagtatttgaggtagttcttaattttctgagagaatacttcatttatacaagcacttatttttcttaaagccaacaaaatagagctctttcataatttaattttggagcattaaaaggagataagaaactatgatacctgtatcatacatacagacttatataaacataaacagcaacagatcttacagctttcatttaaatatcttagccatgttccaggtacagtaatataaaactcctgaatttattaaagactatctggatccaaattgttcttctggccaatggaacaagatttcttgcccagatgactaaagcttttgaataagattcgtgaaggagcttttaagatttttttgtttgatttctgtaaggaacctattataaagaggcaattttttattcatttaatcttttagatgcctctgtgtatcaattaaagaatgcatcccattgcttttgtggcatttttgaacctttcttttctaatgcaccttgcaagtgaacagttttatctaggtcaaaactttcccactgtggccactgtaactcttaagttgtcctcagcaaagttaacccatttttccaaaaatacacatgttcctcataattgttgttcatgaagttagccaccgtcccagaaagtggcgtctcagactctggagtcccagactccttagatttggaggaactcactttcaaaaggcacctgcctgaggcttttaactggatccatttcagttaattatcagatctgatttgctcctggacccagtcctacttgacccagtctaagaattgttcaaataaacttggagaacacaaaacacaaattcctgaagcttggaatctgagatagaactcacccatgacctccagttgctacaagagaacaattggcacagtgtgccctgtcaggtacccttacttggtcactaaatgctcctgagggtcactggagttctacttccgatcccacttctgacaccaatctgttaaaagaaaagctttaggccgggcacggtggctcacgcctgttatcccagcactttgggaggccgaggtgggtggatcacctgaggtcaggagttcaagaccagcctggcctacatggtgaaaccccatctctactaaaaatacaaaaattagtcaggcatggtggtgggcgcctgtagtccaagctactcaggaggctaaggcaggagaattgcttgaagctgggaggtggtggttgcagtgaaccgagatcacgccattacactccagcgtgggggccaagagcgagactgtctcaaaaaaaaaaaaaaaaaaagaaaaagaaaaagaaaaaggaaaagctttagacaaatttagcagagcttatttgaaaaaataagcaattcatgaattcagcagcatgctaaactagtaaagactcggctgggcgtggtggctcacacctgtaatcccagcactttgggaggctgaggcaggcagatcacctgaggtcaggagttcaagaccaccctggctaatatgatgaaaccccatttctactaaaaatacaaaaaaattagctgggcgtggaggcacacacctgtaatcccagctactcaggaggctgaggcaggagaatggcttgaacctgggaggcagaggttgcagtgagccaagatcacaccattgcactccagcctgggcaacaagagtgaaacgccatctcaaaagaaaaaaaaaaaaaacctaaaccagtaaaggctcaaagaactccacctaaccatgtggtcaagtagtacttacagagagaaaaaaagtgacacatagaaatagcctatttagaactcggcatttgctttatctggacaggtctaagcactttgcagtctgcgattggctgaaagctcagttgcaatgattggctgagactcagctacttgttacaagaaactctcatgttaggtttgtttacatattaagttgggtttcagttcactatgtaaggaggcagcttaaggccaaatttaatctaatttaacacctccagcttgaaagacaaaaccaaaccaaatcaaccaagaaacagaaaaaagaaaattcaaagatgtatgagcatgcataactttgataaaaataaaaataataattatttgaattggcaattagaaaatagttatatcctcaggtaacagatgtctctaggtggatgagattgtgggtggtttttcttgttgttgatattttctgtgcatctctaaaaaacatctaatgctttgcaaagaacataagaaacagattagtacattagtggccttggaggaaacaatctcagtaaaacatgtgtttattaatgaatgtattcccccatccctttccaaaaaagttcataggtgtagttatagtcaaaggtaagaggcagtcttgtcagagccagtaaagtaaccaaccatcctggtttgcccaagaccaagcagcttcccaagacactagactttcagtgctaaaaccagagaagtcccatccatactaggagagttgatcactctagtctgtgtaatttgcaaagactctccatatcctttggttcctgtgagtctcaaatccacccagtgaggtacaggtgggccggtggatggtcacctccatttcagaagagaggcagctaaggctcagggaatctccctatccctgacccgggaaaggccttaagagaaagtggtcttttaaactgtgtgtatatatcactttgataaaattaaaaattagttttaaagaagagagagggccaggcgcagtggctcacgcctgtaatcccagcactttcggaggccgaggcgggcaggtcgtaaggtcaagagatcgagaccatcctggctaacacaggtgaaactccatctctattaaaaatacaaaaaaaaaaaaattagccgggcgtagtggtgggcacctgtagtcccagctactccagaggctgaggcaggagaatggcgtgaacctgggaggcggagttttcagtgagccgagattgcgccactgcactccagcctgggcgacagagtgagactccatctcaaaaaaaaaaaaaaaaaaaagagtgagggccaggcgcagccgtcacgcctgtaatcccagcactttcggaggccgatgcgggcagatcacgaggtcaagagatcgagaccatcctggccaacatggtgaaaccccgtctctactaaaaatacaaaaattagccaggcgtggtggtgggcgcctgtagtcccagctactcaggaggctgaggcaggagaatcgcttgaacccgggaggcagaggttgcagtgagccaagatggcaacactgcactccagcctggcaacagagtgagactctgtctcaaaaaaaaaaaaaaaaacaaaaacaaaaaaaaaagagtgggaatccagaatgatagaaagaaaatgagcctgggagggatgaactgcagaggaccataaggtaacatgggagcagttttgcaggtgtatacaactgtcaaaactcactgattgtacactttaattgggtgcagtttttgttgcccttaaattatgcctcaattagagagaaagagagagaatataaggaaatgggggcagccatggcgtccttggagaattcacacttgggacgacaactgctcatttgtgtactctctcctcctcacctgtcttccactccacccctgtctctgatggaacatctctccagctaagccatcttcctcaaggcagcccaattctctgtggggctgccacagcactaaactgttctctgtgtccccaggactccaacctgtctgtgcacacagaaaacccggacctcactccctgcttccagaactccctgctggcctgggtgccctgcatctacctgtgggtcgccctgccctgctacttgctctacctgcggcaccattgtcgtggctacatcatcctctcccacctgtccaagctcaagatggtcagtggctcagggatctcctaccgatggggctgggccctggggattctgcttttattttttaatttaattaaattaattaattaattaatttagagacagagtctcactctgtcgcccaggctggagtgcagtggcatgatcttggctcactgcaacctctgccttctgggttcaagcgattctcctgcctcagcctcctgagtagctgggattacaggcatgcgccaccacacccagctaatttttgtatttttagtagagatggggttttgccattttggcaggctggtctccaactcctgacctcaggtgatcagcctcccaaagtgctgggattagaggcatgagccactgtgcccagccagcattctggttttaatgaggccctctcccacctcctcggctggactgggttccccagtctcacctgacctgcttggggtcatgggaatctgacaactgagaatatatacagccagctgacatattccccacttgggaaagtttaagtaagttcagcaacactctccccacctccagcaagcttctggtcagctccattcccagacctcagtgccagtcccaggcaggtctagtggattctggtggcttcaggtacaaagaccccttcccagtgaggactgtccttgcctctggggatgcggattccaacctgtgctctcttcgcaggtcctgggtgtcctgctgtggtgcgtctcctgggcggaccttttttactccttccatggcctggtccatggccgggcccctgcccctgttttctttgtcacccccttggtggtgggggtcaccatggtcagtgtggggccctgggaaagtggatgggggaggtctccattgggttgtggactgtgatagggaaactgtgggctctgaggagagggctggacatattgggaatgggaagaagaagggggtggccccagaaacttctggccatgtgggatggggagaaatggaggcaggtccagatgtgtgtgttctgcccgggcctccctgccctccctgcacagctgctggccaccctgctgatacagtatgagcggctgcagggcgtacagtcttcgggggtcctcattatcttctggttcctgtgtgtggtctgcgccatcgtcccattccgctccaagatccttttagccaaggcagaggtaaggttgggggagaggggaacctgccaggtttagccctgataggagggtgacctcagggttcaaagtcactgctgggtcccaggtccctccctcgaggcttcaagtacaaacacaattgtgttgttctccacttgctacatttctacctggaagcaggctgaggagggggcaccagtgtaacacaggaatgagccaagatgccaccactgttggaccatcatgtgagggtagggggctgttccacagcacccacccaccaagtgcaatatctgacgtgggtgtcagtcagtgcctgtgtaatgaacacatgtatgcagacaagtgtgaagagttctggcttacctagaggtcccattagcatgttcccttcctttcttcccacctccctcagttcctggccttcctcttgatcttcagtggctgtgatgttgggctggtgggatggaacactgcaggccaacctagtgcctcccatttctccatctcagcgggaagcaggcaaggagagtagcaaagaacataggctgtgaacaacccacttactccccatgtgggctcgggcgggtcgctgaaacctttggagcctcatttccttaattgcagaaagggcgtcatgagctgtcctgcctgtaggctgatgtcccagttagacaaggtcatgtaggtaaggtgatggcaccacacctggcacaggtgccacacctggtcctcgctgaaccagagctcccttgtgatccttcctcatctctcagagtcctctgagtggggacctggaggcccccaggtgctgcctcctgccccagaggagactgatgccccaagggactccgcagggcaggggctgcaggcccaggcttttccagtgcttctgacgcccctccactctcccacccagggtgagatctcagaccccttccgcttcaccaccttctacatccactttgccctggtactctctgccctcatcttggcctgcttcagggagaaacctccatttttctccgcaaagaatgtcgaccctgtgagtttcccatggagggtgcgggggctccacagctgagtcctcagcccaactctgaccagcagcccccaacccctccagttcctttcaaagtgggagagaggtcatccccacaatctgtaaactggggcttggagcaggaacaagggtcccctccatttccctactctgctttgagagggtggtgggcactcctgattcccccgtcctattctctcgccttctagaacccctaccctgagaccagcgctggctttctctcccgcctgtttttctggtggttcacaaagtgagttggctcttccaccagccaggccagagggaggggagggatggaaggtgagatggagaaaggggagcagggcagcagtttagggaccgggctggccacctatcccaccccccaccgcagtgggcacagggcagatgagggtagggaagtggtctgggagggggaccaaatgcagaggcctggcctggcccagtgccgcccccaggctacaggccagccctgcatctggcaggctgtggggacaggcccaggaggctggaagaagactgtcattagttctgagctcctctgtttgtgataaacttgcagcctgtcatctccttggctgcgcctcagagcggcttgagcaggataactgtgtctgtgacctgggtgacagctcattaaccccacagcactgaggaagcacccgaggctggggccaaattgcccaggcctcgtcctcacccagggccccaggcagcgtggattccatcaccagggcctggggtggggaggagatgggacacctggggaggaggaggagaagggggtagtggtaggaacttcggagggagagccagtgacctcaagcctattcactgaggaaatgaaggagacacctttcatggtcacagtgcccgagggagaccctcctttctggagaccctggggccctggagacactgacccttggctccaggctgctaaaccctgaccctctgcggggctgcctgccgggcttcacctccccccaggatggccatctatggctaccggcatcccctggaggagaaggacctctggtccctaaaggaagaggacagatcccagatggtggtgcagcagctgctggaggcatggaggaagcaggaaaagcagacggcacggtgaggccctccccttgccccaacacccagccccttcgcttaccccagatctcctgcagaggacgctggtagaccttggagggcggcattgctggggtggcaagcagagcaggaccaggtgatttcttggcagcctcgggaccattctatgggaagcttaggcctggatggcgctagttctcccagctctggtgggggcaggagaatggctggcactttggagcaactactccatcccaggtcccatcctaaggatataaataaactcacttaatttttcaacagccctaaagggtaggttcaagtgtccctgtgttacagatggggacactggggccgggtgtggtggctcacagctgtaatcctaacactttgagatgccaaggcaggaggattgcttgagtccaagagttcaagaccagcctgggcaatatagtgagaccttgtctctacaaaaaataaacaagatgagccgggcatggtggtgtgcacctgtagtcccagctacttgagaggctgaggtgggaggatcatttgagcccaagaggtcaaggctatagtgagctgagattgtgccactgtactccagtctgggcaatagagtgagaccttttctcaacaacaacaaaaacagatggagacaccgaagcacagaaatttaacagagggcctcccagggtccccaagttggtggtggcagagctggaatccacatggagccggctggccccagaggttctcctcatatcactgcaccaccctgcctgactgagagggctgattccagggccaggagccagcacacccctgccaattctgcctcctcctgtctggaggcggcggctgaatgagatgatcttcccctgaggggtcttcccactgtcagcctcttatcaaggaccacaaacctgtctctggccaactgcctcaccaagagagctgacgctgagcatcatctttctccacccaattctgaccccaggattgaaccctccctcctcccatccacaatccaggcctaggagttcaatgtttgctcagcccggagcttccggttgtcaccagctgttggaggagcctggggctgggcatggttagcagtatcctggctttcatggcttggagcctccacgaagacctatgggcccccagtctgcctgctgcaccccctctcagtccctccatgccactccaccccctccctgttcagctgcccggtggctgtaccaacagccatccttgatcttatctaccttccctcttggcgtcctccctggagccagcactggggaggcggggagagggccagactggggggatagctgggttttagagtccttgtggtagcagtctggccaccccttcagatgccctctggcagctgaggacagagtcgcttgtgcaattcttatgctgtctgttcccctcccagctctgagagccaagaaaacagctccttcctcctcctcactcctagccagcccagcctagcccttggcttcctggagcccctgtccccattcctaacccactgctccttcctccctggaccagacacaaggcttcagcagcacctgggaaaaatgcctccggcgaggacgaggtgctgctgggtgcccggcccaggccccggaagccctccttcctgaaggccctgctggccaccttcggctccagcttcctcatcagtgcctgcttcaagcttatccaggacctgctctccttcatcaatccacagctgctcaggtctctccacactccggctcactatagccctgccctgggcagcagggctggctggctagcccagaggaaggaacaacgtacagtgaaaagaaccccagaccaggaaccagggaggctagctccactttctgtgtgacctttggcaagtggcattgcctgacttgtttcctcactcacattcaacttagaattgctgtgcatatactatgtgccgggcaccgtggtgtgtacgttaacaagcattgggtctttaaatcttcccaacaatcctatgcggaattgccccattcccatgtcacagatgagaaagcaggaactcagagaggtgaagtgacttggccaagggcacacagcaaagaaggaatcaggtctgagtccaggactctgagctccgactgaggtgctctgtccccaccatcaggctctaacatctgtctcaggaatggcttggactagaacgagctctcaaatgagagggtgggaaggagagctgcctagtagctaagtccccacctccttgcccctccgtgcatgcattaatttgttcagcaaacatttattgaacctccagggtaccagaatggtgctcgatactagggatacagagttcaataagacagggtcttgatgtcttatgggagaaaccagcgtgtaaatcaattagaattcagtgggggcagaagtgttctcgggtgtctggaaaaccccgggaggggcaaagaagccagcctgggatgcagcaggaagcacccactggcttgggaggtcaacgaatttggagagacaagtaggtgaagaaacaggggaaagttcagcctcagcttagtcacaaagccctgaaacagcatgactcaggtgtttctgagtggcagaggaaatggcaacgagagggaggggcaggaaaacagagagagggagagctaaggatatccttgaaagatctgagccagggaggggcatctggcttcaaggatctcctgccaggagtgtgggggatgtagggcagggtggctggatggaagtgggccaacccggtcagatggagtccaggccaggaatgagacaagtattcaggagcaatttgggagatgggcgtgtgcgccagagagacagaggagtgccaggcaacctgggtgctggcctgggtaactggaggacgatggatcttttgctgagctgatgggctcggtgggaggaggaggctgggtggggggcaaggtggtggatggagtctggtcatgtggggccagtggtgctggtgggtcctccaaggggagattcccagctagctggaagtcaaactctcgagcccaagagtttgagaccagcctgagcaacatagcaagaccctgtctctacaaaaaagttaagatattagccaggcctggtggcatacgcctagagtcctagctactcaagaggctgaggtgggaagactgcctgagcctgagaggttgaggctgccgtgagctgtgatggcaccaccgcactccagtctaggtgacagagagagaccctgtctcaaaaaaaaaaaaaaaaaaaaagagagagagagacaccagtcactgggctggggccactggggcccaccctactccaatatgacctcaccaaatgaggccacgttcacaggtaccaggtgttgggagctgaacatatctttctgggagacacaacttaagctatcacagaaggggaggcctggctatgattatggctggagggctccatgtagtcgagaggagagtgtcccaacaatgaagagactcggtcatgtcaataggtgaaggtgtagagcttccagcagaggtggccagggtgaagctcagcggcaaagggggcaacagcgcagcaagttcctgaggaggcagaggaaggccagggctcgggggcaggggcagcctccgacagcctgagcaccagaaaaaggaggacaagccactggagggcagtttgtgagtggcaaggagtttgtgggtggcagggagttctcaatgggtggctaagcaagaaggcaggtagctgctgagaggggtggggggctgggatgggcctgaagggaagagaagagaggtgaagaaggccccaagagcgggggcggattagggacctagagaaggttgctaggcagtgctgggggccactgagtttggaaaggtggatttgagcggcaagagtctttgtggtcatgtggcggaatctagagcccccagcagcctaggagaaggagcagggaagtccagtcaatggaaacgtggcatttcttcccgccatatgtcaggaggtaagaaggcaggcaggtgaggctggtggtgagagcgtcatcgatagggcgtgcagcagggtccatggtggatagagaacgaggtgaaggcagagtggagccaggaggtcgtggtcttgaggcagtactgggttgaccctccctggcccaagaggttggagggggtggaggtttcagaggccaggggtgcagtggagactgcgggtaaaagcaaagggcagcagaggagggagcagccatgggggcagcactgcccacctcactcctctctcctccccacagcatcctgatcaggtttatctccaaccccatggccccctcctggtggggcttcctggtggctgggctgatgttcctgtgctccatgatgcagtcgctgatcttacaacactattaccactacatctttgtgactggggtgaagtttcgtactgggatcatgggtgtcatctacaggaaggtcagctggagcagggcccaggggaaaggctggccctgggcagcttgcaagaggctcgcagccaagtccacccactactgtctacctgcaggctctggttatcaccaactcagtcaaacgtgcgtccactgtgggggaaattgtcaacctcatgtcagtggatgcccagcgcttcatggaccttgcccccttcctcaatctgctgtggtcagcacccctgcagatcatcctggcgatctacttcctctggcaggtgactctccaaccctgacctctgcctccttcctctgacatgctgcagaagtggcaagagaggattattctggaactgggagcatggcacatgcttgtagtcccagctgctcaggcggctgaggcaagaggatcacttgagcccaagagttctggctgcagtgcgccacgattgtgcctgcgaatagccaccacactccagcctgggcaacatagcaagaccttgtctctaaaaagaaacaaagaaaacagaaaaaaagaaggagggttattctgggttagcagaggggatatagaattgacacaagagctggctgggcacggtggctcacgcctgtaatcccagcattttgggagaccaaggcgggtggatcacgaggtcaggagttcgagaccagcccggccaggatggtgaaaccccatctctactaaaaatacaaaaattagccagacgtggtggcgggtgcctgtagtcacagctactcaggaggctgaggcaggagaatcgcttgaacccaggaggcagaggttgcagtgagccgagatcataccactgcactctagcctgggtgacagagcaagactctgtctcaaaaaaaaaaaaaaaaaaaaaaaaagaattgacacaagagcttccctaggcattggtggggatggagggataggacttcgaggatgctgatgtctgcaaaggaatcttcccaacatctgttgctatccttcctgcagaagccagggaggaaagaaagtcttggagggaggtgggtgtgactctggctgtcatcgtctatatttgccttcctgtgtgtctggacacccttctatatctgctgtctgtccctgtcgtcgttatctaatggctggctgcttctacaaatgttgtggtcattctgactttctatctgtttggccaaccaccatcttttgcttcctgcccatctacacatttcaagttaacaggcctctgtttgcctgttgggttctctctgtagactttggtaatctgtccctatgtgtcatctatccaccggtgcctcctcagaacctaggtccctctgtcctggctggagtcgctttcatggtcttgctgattccactcaacggagctgtggccgtgaagatgcgcgccttccaggtaggtgctgtcagaggtgcatcctcctgcctgcagcacccggccggctgcctgggggaaggtgtccactaaccttggggcctcccaactaccttgcttcctgagtatggatggctactagccatttgcagaaaccatagctcactcttccctcacagctctcagagggttttactgacattctcattttgtagcagaagaccaacgcttagagaaataatggcagtccagaatcaggcagggctgggactcaaacctgactatcctggtctaacaaggagttttcccgctgcactgtgctaagcatgaatagccagtcactcagtctactatttgcaaacatttcttgaagtgttttttttctttttttttttttttgagacagggtctcgttctgtcacccatgctggaatgcagtggcatgatctcggctcactgcaacctctgcctcccgggttcaagcgatcttcctgcctcagcctccctagtagctgggactacaggcacatgccaccacacccggcttatttttgtatttttttttttagtagagatggggtttcaccatgttggccaggctggtctcaaactcctgacctcaggtgatccgttcatcttagcctcccaaagtgctgggattacaggtgtgagccatcacacctggcctattgaagtctactagcttcccactgcccataggaaaaatgacaaaccccctaagaagactcagcaggcttctgcttaccttgcaagtcctcaccccctgcggactggccaagtttcagccagtctggtcttctttcttttctccacagcaccaagctcagggtacctctaggggccaccacatatactattccctctgcctggaatgcttgtcatccccctcttgcctgcctaactcctttccttcccttacctctcggcattgaagtcacttcctcggctgggcacggtggctcatgcctgtaatcccagagctttgggaggccgaggcaggtggatcacctgaggttgggagatcgagaccagccagaccaacatggagaaaccccgtctctactaaaaatacaaaattagccgggcatggtggcacatgcctgtaatcccagctactctggagtctgaggcaggagaatcccttgaatccaggaggcagaggttgcggtgagccaagatcgcgccattgcactcccacctgggcaacaagagcgaaactccgtctcaaaaaaaaaagtcacttcctccagaagtccaccctgactgcccagtctcagtctaagttagtttccctgccatcacctcattactttcttacaggatcctgtgatttcccatcagaacacacataatgattaataattaagcatttattcagatcattgtttgcttattgtatgcctcccccatcagatcgtcagctgtatcatggcaggggccttgtctgaattcatcgtgacaaattctacacgtagcccatggcctggcacatagtaggcactccataaataggggttgaatgaatacattaatctggtgtgccacaccttgggctaaggtcttggagaacaaagagaaataaatagtccatcccctcaggaagctcacagtctgattagagaaacatatatgtaaaggaatggttatggaacaaaaggaaagtgcaatgtgctttagaaacccagggaaggggaccaggtgtggtggctcacacctgtaatcccagcacttggggaggccaaggtgggaggatcacatgaggccaggagtttgaaatcagcctgggcaacagagtgagacctcgtccctacaaaaaaatttaaaaattagctgggcatggttgttcatgcctgtagttccagctagtcaggaggctgagacaggaggatcaaaggagcccaggagtttgaggctgcagtgagctatgattgtaccactgcagtccagcctgggcaacacagtgaggcaccatctctaaaataaataatactagcaataataataagaagaagaaaaagaagtagtaggagaagaaacccagggcaggggacagaggatgctgcctggggaggccggtgcagtggcactgagggtggagatggatcttgtcaggcagaggacacagggaggcaggggctgtgcattccaggccaaggcacagcacaggcccagcaaggagttgtgagaaggaatggtgggcagcgtggaatggctgcaatggatgagaatggatggaaggtaggaccctgtgagcaggaggtcaggggagggagcaggtgtgccactgacactctttctgcctgcacaggtaaagcaaatgaaattgaaggactcgcgcatcaagctgatgagtgagatcctgaacggcatcaaggtgctgaagctgtacgcctgggagcccagcttcctgaagcaggtggagggcatcaggcagggtgagctccagctgctgcgcacggcggcctacctccacaccacaaccaccttcacctggatgtgcagccccttcctggtgaggcttggcacagggctgggtccctgcctccagggctctgggtgcccaggcatggccagggctcattggactctaccctgacaccacctccacgctgctcaggtgaccctgatcaccctctgggtgtacgtgtacgtggacccaaacaatgtgctggacgccgagaaggcctttgtgtctgtgtccttgtttaatatcttaagacttcccctcaacatgctgccccagttaatcagcaacctgactcaggtaaccctgggtagggctgggggctctactggagttggaacaggttgttggggtcagggaagggtcacttagggcaagggataatcagggggagttattggattcagggaaggttgctagcattatgaagagctattcaaggttgaatgaggtcattaaggtcaggggtcatttggagtcacaggtggtcaggtcgggtgtctggaaacctgagttctgtagatagcctcctcttaccaacctggactttctctttgggcagtgggagccatggaagactcagtcgtgggagggaccccagtgctagtgtctgggccctcagggggtcctgcctagcccaggatgctggggatggggcgagggtaggggttgggggttgggaaagtacagtctctagggctgactcacatcctcccgtaggccagtgtgtctctgaaacggatccagcaattcctgagccaagaggaacttgacccccagagtgtggaaagaaagaccatctccccaggtctagagagcccctacctgggctgcctgccccagtccttgctccagaaaaacctctgtttcaagcttttcctttgttctctcctgaccccttttcttcttcctctgttcacatctgcttcgactctgacctcctccctcttccgggttctctgctctcctccgccctcctccacagggctccccacatccctttcttcctcccttttcccaaggatcccctccccatggcccaggctcctcccctgtcctcctttcccctgccccccagcctccctgcaggctaccccatcccttgagctccctccctgaccctgcccaccttggtcctctcaggctatgccatcaccatacacagtggcaccttcacctgggcccaggacctgccccccactctgcacaggtaccagcttctcccactcccttcccagctgcccacggtgggctggaagttcagatcaatagcagcaccctgcaaagcctttgaccaagaatgcaggaagagcttcagcctgccaggggggtgtctggaagggcggagggcttggttctgcaggtggagggttggagaccaaaaccctgatccctgcctctaactggactcctggggtccttgcccccagcctagacatccaggtcccgaaaggggcactggtggccgtggtggggcctgtgggctgtgggaagtcctccctggtgtctgccctgctgggagagatggagaagctagaaggcaaagtgcacatgaaggtgagagaggcaggggctcctgggcagggtgtggggctcagccaggccttgggcaagccccgaggtaaatttctcctgtggccagggctccgtggcctatgtgccccagcaggcatggatccagaactgcactcttcaggaaaacgtgcttttcggcaaagccctgaaccccaagcgctaccagcagactctggaggcctgtgccttgctagctgacctggagatgctgcctggtggggatcagacagagattggagagaaggtacagagtcctcttccatccctaagaggctagggcatagagctgcccacctcaacccagcccaggtccatatattcatcccttcattcacacattggtgtaacgttatgcccaactctgtgccaggcactggggaaacagatctattagcagatctgtttagtgaacaagtaggaactattgaatattctaggagccaggctgaaggcctgtgcagggtacagggagggcacagcagggagcctacataaggaagagcatcactttttttttttctttctttctgagataaggcctcactctgttgcccaggatggagtgccatggtgacatcatgggacgctgcagcttggaactcctgggctcaagtgatcctctcgcctcagcctcctgagtatctgggaccacaggcacatgccaccatacccagctaaatttttaattttttttagagacagcgtcttgccatgtcgcccaggctggctcaggagatcctcccaccctggcctcccagagtactgggattacaggcatgagctgctgcacctggctgagcatcactttttttttttagacagagccttgctctgtcacccaggctggagtgcagtggcgcagatcatggctcactgcaacctccacctcccgggttcaagcaattctcgtgtctcagccacccgagtagctgggattacgggtgcgcaccaccacacttggctaatttttgtgtttttagtacagacggggttttgccatgttggcccatctggtcttgaactcctggcttcaagtgatccccccgcctcagcctctcaaagtgctgggattacaggcatgagcaccgtgcctagccttaagcatcacttttgacctcagttttaacaactgaggaggaggagctcatcatgtatctgttcattcatttaccatatatttattaagcacccactctattctgggaaatagtatacagtagtgaatactaaaatgccgggctaatatctctaccttcatatagctcacattctagtggcaggaagagataataagtaagataaataagtacaatatataatatgttagataaatgctcagtggaaaaaataaagcggggaaggaatacaggaatgcctgcagagttgaatggttaaggtagcttgggaaatcctcactgagaatcagagaactcaacaaagagaccgagtgagccttgtctggagccagaaagctctgtctggggccatggaaccctgtatggggtcttggagttctctggcatgactaggagttgggaaatggagggaaaagatagagagaggcagaaccctgattaccttggttaagattttggcctttactctaaaaaacatggaacactggggaaaatttggggctttgctttttaacaatttttaactgtggtaaaaaccacacataacataaaatatatcatcttgcccggcatggtggctcccagcactctgggaggctgaggcaggtgtatcatttgaggtaaggagttcaaggccagccttgctaacatgataaaaccccatctctactagaaatacaaacaaattagccgagtgtgatggcgtgtgcctgtagtcccagctactcaggaggctgaggcaggagcattgcgtaagcccaggaggcggaggttgcaatgaactgagattgattgtatcactgcattccagcctgggcgacagagcaagactctgtcttaaaaaaaaaaaaaagaaaaaaaaacttaatcatttcttagtgtacagttcagcaatgttaagtacatttacattgctgtgcaaccgatctccagaaccttttcatcttgcaaaactaaaattgtgcctattaagcaactcctcattccccactgcccctaggccccagtaaccaccattctattttctgttcctaggaatttgactacttagtatcttagtccattttctattgcttataagagaatgcctgaaactaggtaatttataaagaaaagaaatgtattttgtacagttacggaggctgaagagtccacggtccaggggctgcatctggagagggcctccttgttggcggggagtctgcagagtcccaaggccatacagggcatcccatggcaaggggaccgagcatgctagctcaggtctctcttccttccttccttttttttttttttttttttttttttttttgagacaaggcttcactctgttgcccagactgtagattggagtacagcggcgtgatcttggctcactgcaacctccgcctcccaggttcaaacgattctccttcctcagcctcccgaatagctgggattacaggcgcacgcaactacagcccgactaatttttgtatttttagtagagatgggtttcaccatattggccatgctggtcttgaactcctgacttcaaatgatccacccacctcgacctcccaaattgctgggattacaggcatgagccaccacgcgcgacctcaggtttctctttctttcttataaagccaccggtcccactcccccagtaacccattcacgcatcaacctattaatccataaatggatcaaccattcatgagggctctgttttcatgacctaatcacctggtaaatgccacccctcaatcctgccacactggggggtaagtttcaacatgcactttggaaggaacaaatatttcaaccatatcacctaggtacctcacgtaagtggaatcatccagcatttgtcttttcgtgacgggcttatttcacttagcataatgtcctcaaggcatatccatgttgtagcatgtgtcagaatttccctccttgtaaggctgaatgatatttcattataggtatatacacatttgtgtgcccatttatccgtagatgggttgggcaggacaccaagctgggcagggtggtgaccaatggagcagaatggcctcacctgccccaggaggacttaccctttacctctgtccctcacagcattgcagggacagactaggccccatgtgaaatatagattcagaagactgctgttctggtcaggcacagtggctcacacctgtaatcccagcactttactttgggaggctgacgtgggccaattgcttgagctcaggagttggagaccaggctgggcaacatatggagattctgtctctataaaaaataaaacattttagtcagtagccaggcatggtggtcctgcaatcaatcctagctactcgggaggctgaggcatgagaattgctcaaacgcgagaggcagaggttgcagtgagccaagatcgcaccactgcactccagcctgggtgagtgagaccccatctcaggaaaaaaaaaaaaaaatctgccatcccaaataacagtggacaggccgttgtctccctgtgcctgtctgaccccatttttcccaccccccgcctccctccagggcattaacctgtctgggggccagcggcagcgggtcagtctggctcgagctgtttacagtgatgccgatattttcttgctggatgacccactgtccgcggtggactctcatgtggccaagcacatctttgaccacgtcatcgggccagaaggcgtgctggcaggcaaggtgaggcctgccagaggctaagggggctaaggtgagatctgaggcccgaagagagagctggtgagaggctgaggggtttggatgagacttggaggtgtggggggcgcaagaagtgggcatgtgggttgggcatcaggagaaacctgtggggacaactcccccacctgcgaggttctgagcaggctgtggcgagcacagggtgagtcacccatgtgcctgtccaagctccctggcacatgggcacacttcacactcactctgtggctccgtgcctgtgccaggggtgtgctggagggtggtaggggtgagagcctgctgccttctccccagacgcgagtgctggtgacgcacggcattagcttcctgccccagacagacttcatcattgtgctagctgatggacaggtgtctgagatgggcccgtacccagccctgctgcagcgcaacggctcctttgccaactttctctgcaactatgcccccgatgaggaccaagggcacctggaggacagctggaccggtatctgccatcctgggccctctgattcccatgccttcccagcattccccctgtctggggtctctgagtgtgtctagactggcctagtgttgtgccaggcaggttctgggaaacttgggccatctgtgtgacagtcaccagaggtaaagtaaactggacatagtcgggtcccactgcctcctccatcctactctaccctaactgtgggaactcagatcctccgccccggtctcagagcctgttttctttctttctttctttctttctttctttctttctttctttctttctttctttctttctttctttctttctttctttctctctctctctctctctctctctctctctctctctctctctctctctctctctctctttctttctttctttctttctttctttctttctttcttttttttcttttgaggcagagtctggctctgtcgccgggctggagtgcagtggtacaatctcagctcactgcaacctctgcctcccaggttcaagtgattctcctgcctcaggctcccgagtagctgggactacaggcatgcgccaccacgcctggctaatttttgtatttttagtacagacatggtttcaccatgttggccaggatggtctcgatctcttgacctcgtgatctgcctgcctcggcctcccaaagtgctgggattacaggtgtgagccaccttgcccgatctcagagcctgttttccatctgttgaaagcataggagggcccaggcccagcttgtgtggcaaggctgcttcatggataaatagtttggcaagtatgcaagtgcttagcaaagccgcttatttatcaaccaaaatttattggacaatcactatatacaggcactgttccagacactaagctatagcagtgagcaaacaaaaaaattatagtcctcatggagcttgttgacgtctctgggctcacaacatgcccctggctccttgttgcccagacccagctccccagcccccaattctggattggctcacagaccttttcctgggctttcttgcctatggctatacatacagccaacgtgccttgagcatttaccaagtgctgtgcccctcgctcacacactggacacattttcttttaagcctacagtcatgcagattttttttttttttttttggggacagtttctcactctgttgcccaggctggagtgcaacggtgcgatcttggctcactgcaacctttgcctcctgggttcaagcgattctcctgcctcagcctcccgagtagccaggattataggtgcccgccaccacgcccggctaatttttgtatttttagtagagacggggtttcaccatgttggccaggctggtctcgatctcctgacctcgtgagctgcctgcctcagcctcccaaagtgctgggattacaggcgtgagccaccatgcccgaccaaggacgtgagttttaagctcagccagtctaactccagagcccaagttcctaacccttgtatttgagtccgtttctccataatttgtgaagagagtttttcttgttgcttaacccaagtctttcttgttgccctttcaatccccctcattttattttcatgcttgtccattgaacccctttcattagagtggggaatgggagataccaggggcttgcagggagaactagctgaaccctatctccttcctcccaccctactgcagcgttggaaggtgcagaggataaggaggcactgctgattgaagacacactcagcaaccacacggatctgacagacaatgatccagtcacctatgtggtccagaagcagtttatgaggtgagttcctgagagctcccagccctcccggaggctgtatcaggcctccccaggccctgccagatggggtgcaggtttctccctgacactcccagcctctgtcctggggggtgcttgaggccccctccctgggcctgaccagctgcctccacagacagctgagtgccctgtcctcagatggggagggacagggtcggcctgtaccccggaggcacctgggtccatcagagaaggtgcaggtgacagaggcgaaggcagatggggcactgacccaggaggagaaagcagccattggcactgtgagtcggtggggcaagaggggctggaggggatggacaggcaggccccagcagccccagggtttatggagtcccctgtccctgactgccatggctgctccctacaggtggagctcagtgtgttctgggattatgccaaggccgtggggctctgtaccacgctggccatctgtctcctgtatgtgggtcaaagtgcggctgccattggagccaatgtgtggctcagtgcctggacaaatgatgccatggcagacagtagacagaacaacacttccctgaggctgggcgtctatgctgctttaggaattctgcaaggtgagcttgtgggggtgtccagaaggggctccaatatcccttcttctctgggctgccaggccccccaaaccgtgcccttgcatccaagcctccctaacccactctggtcaacccgtgtctctgattctgcccctttgtgcccgctcactagtccaggtgagccagcgccctctgccttctccaacagggttcttggtgatgctggcagccatggccatggcagcgggtggcatccaggctgcccgtgtgttgcaccaggcactgctgcacaacaagatacgctcgccacagtccttctttgacaccacaccatcaggccgcatcctgaactgcttctccaaggacatctatgtcgttgatgaggttctggcccctgtcatcctcatgctgctcaattccttcttcaacgccatctccactcttgtggtcatcatggccagcacgccgctcttcactgtggtcatcctgcccctggctgtgctctacaccttagtgcaggtgtggggtgggcgtgattccagtgtgggcgtggtgttattggggcggggcaacacatgggcgggggcagcaggggtgggacacttcaggccaccaacattacagagttttgttaggggcagtcgttgcttaacatttatgttaggggagccattacttaacctctttgaaactcatttgcctcacctgtaaaatagaatgactcatagaccttcctcatggagttggtgagagaataaaatgaaatagttatacattgtagctggcactgggactttcctgttggctttttttttttggggggggggggacggaatctcgagtctcgctctgtcgctcaggctggagtgcagctgcacgatctcagctcactgtaacctccgcctcccaggttcaagcaattctgtttcagcctcccaggtagctgggattacaggcatgcgccaccacgcccagctaatttttgtagttttagtagagatggggtttcactatgttggccaggctgctcttgaactcctgacctcaagtgatccgcccacctcggcctcccaaagtgctgggattacaggtgggaaccaccatacccggccttcctgttggctgttttttgataaaacattgtcaacagtttgggacacattatcctttccttccttttatacatatctaaacatacgtgtatgcatgcgtttaacatagatgagttgataaccttcagatacagctaactgtaaaaggcctttgcagacactgaactcctgttctgtaatgaattagtcagttcccggggatagatgctcaacacctgggtatagcgaccatgatctaggctgtgctctgtgctgggctaggggagaatcagatagacatcctgtatagcctggatatctgaggccacagaggagaggatggaaactggaggcagagccgtgttgttgtggggttgaagcagagatgatcagagggagggagtgaatgacacatcaaggccccaagtcttgggtccttggaggtgggggaaggcagcgatgtctcgtggtgggagtgaggctggctgggaggactcatctgaaaatggatgagttcagagacaggcaggactgagttgggggttccatggccctgaccccaaactccttctccctccatcagcgcttctatgcagccacatcacggcaactgaagcggctggaatcagtcagccgctcacctatctactcccacttttcggagacagtgactggtgccagtgtcatccgggcctacaaccgcagccgggattttgagatcatcagtgatactaaggtggatgccaaccagagaagctgctacccctacatcatctccaaccggtcagaagccgcctccctcgctccctgctcctccaggaattcccagcaggctctctggtgttcagggtccttgtccctcctttcccctaagcagaaaactggccctgccctgcccctgccccatttcctcctcatctgatcccccataggtggctgagcatcggagtggagttcgtggggaactgcgtggtgctctttgctgcactatttgccgtcatcgggaggagcagcctgaacccggggctggtgggcctttctgtgtcctactccttgcaggtatgaagggcctggaccccagggcagggccaccactgggacagaaaccacacaggtgttccaggcatctcccgagtgcccctccctgctcagtatgggcaccagccacagggtctgttctcaaggactgtgagaaaaaaaaaaaaagaaaaaaatcattgagttgacaagtttataaccacacaccatggctggatgttcctactttccttccccaagaagcccatgttctcacattcagaaagaattctgttgaataatctctgtcctcaaaccccacatctctctcctgctcagccgtcgaccttgcctgacacctcacagttcaactggagagacccccatcagcaggagattgtgctgcaggctgagcaggtctttgtggctggagaaacaaaatgttttaaaagcccagaagagggactgggtgcagtggctcacacctaatcccagcactttgggaggcggaggtgggcggatcacctgaggccaggagctccagaacagcctggccaacatggtgaaaccctatctctacttaaatacaaaaattagccagccgtggtggcgggcatctgtaatcccagctactcaggaggctgaggcaggagaatagcttgaacctgggaggcagaggttgcagtgagccaagatcacgccactgcactccagcctgggtgacagagcgagactccatctcaagagagaaaaaaaaaaagtccagaggagttttcttgctttggggtgttgtagaaatgatcttggagcttagccccaaaggacaaacagaatttctcttgtctctgggcaagttgtaggctcatgtgacaggtcaggacagtgtagggctggcataccgctcgctcacgttcacatgcttgcagagaacgtacacagacgaggtgactgaagcctggtctgcaggtcaggcaggtcatcctgatgccagcttgtactgtcaaagagtcacctaactgcaaacggaatttttgtaaagcagatcacattgttaatacctcaggtggctcaaaccttgaacgcgttggcaaacaaaaaacaatccagaaaggtcaattttcacaaaggtcagtgtgcacatgaatctacttgttaaaatgtacattttgattcagtagacctaggatggggctcaggactctgcactttgatcaagactccttggtacgcaaagtgtggcccatgggccagttgcatcaccatcctctgggagcttgttagaaatgaagaatctcaggttccaagtcccacctcagactacagaatccggcgttgcattttaacaagattctctgggaagtcttatacatattaaagttggagaaacagaaaccaaggcgaggtggtccttggttaagtctgcactgtcactgcccaagggagtcattcgtgattacagccccagctggcatgcctgtgggcttgatccaggcccacctgggtcatccatgggctaggatcccatggatgggcacatgatccaggagtctgaactcctcccaaagccattacggtggggaggggagatcgccatacgtataacccagtccctttggccaggtgacatttgctctgaactggatgatacgaatgatgtcagatttggaatctaacatcgtggctgtggagagggtcaaggagtactccaagacagagacagaggtgggtactggcatgagcccgggacagggggaatctgaagtagctggggaagaaagcttggtggctctctctccctcaacatcagggcctgccacgtatggggctcttcattcatttacccattcactccttactgagcatcaaccaatgctctatgctaggaggtgtagagagatcagagttgagcaagacggtgtttgcccttaggtgattctgatttggtgggaggggtaagacctattgcagggctttgcagtggatgaccagatctctggcgtggtgcacctggagagggcagatgagggagatccttcagctggggtgaccaggggagacgagcttagatgagaaggatggacaggctttgatagactaagtaagatggtggggtgggcagtgggaaggtgagcattccagccaaagagaccagcctgggcaaaggagtggaggtggggcagcatgccctttgttggggaaaaggagttgttccctactgggggttccagacttttctccaccgccccctctcatggtcacaccttagccctcttcatgcccagaagctgcagcatcagtgtcaagcatcccatctttggcccacgctcctatcctgctcgctctcatgctccaagtcccccactgtcacagcagtctgccttcactgggactcccaatcccatgacccccctttgtgtctctgtccatcagcttctctgccttcacctccctccccggccagcctagagtctatgctccaccaacacaaacgctctcacctgccttgcccttctctttcttctctctcagttgtactcacctccaaaacccaccccagctgagcccaccaatctgccttcttcatgcctgcactgagcacttaaaaccttgcaggaggcggggcacagtgactcatgcctgtaatcccagcactttgggaggccaaggtgggtggatctcttgaggtcgggagttcaaaaccagcctggccaacatggtgaaaccccatctctactaaaaatacaaaaaaatagctgggcgtggtggtgcacacctgtattcccagctacttgggagtccaaggcaggagaatcgcttgaacccaggcggtggaggttgcagtgagccgagattgcgccactgcaccccagcctggataacagagtgagactctgtctaaaaaaaaaaaaagcttgcaggagaaaaatcactgagttgacaagtttataaccacacaccacggctgcatgttcctgctttgcttccccaagaagcccatgttctcacgttcagaaagaattctgttgaataatctctgtcctcaaaccccacatctccctcctgctcagccatcgaccttgcctgacacctccataaaaagtaggttctaagacgtgaactccctcaaccttcctgcctctcagtctttaaacccgcctgtgtctccttcaccgttgtctccttttcacttttagcaggaatcatccctttctgtttcaaagcccagcccctccatttcttctcatggccgcttgaggacctggcttcctcagtcccgccctccatctcctgtcattcttgctccctctgttggacgcttcccatccacatgcaaaaatattccatcacatcttccattccagacacacacgcaaaccctcccccctgcactccactgccccatttctctgctctcctctgtcatgaagcatggtttaaagtatggtctctacaagctgcatccgcttcctcatcagccttgatgtcatctgcctcctgcagtcctctttctggccctcgctccacggagacagctcaccagtgaccttcctggttccaaatccaggggacgcttttctgttctcgtctaattcaacctcttagcaacgtcccaataaaatgacctctcccttcttcttggagtcctcgtggattccgtggcctgcattgcacccgccagtccacctgcctgaccccagcctggcttccccaggcatcaccctctggcccctcacccctcactgtctgggagcttccagttcccctgcttcatgtctagcagcccagttcctgcatggatacccatgctcctgtctctgtatcctataaatgtctgccctcaaccccacggcccgttctctgacgcctccttgagagaccaatctgtgcctgctgctctgctttttcacctctggccgcgtggtttctcctgcctcgaagcagggctggctccacaggaatagtcacagcgtccccactcccggaagaactgcgcgtttagagtaatgctctgccgtcagtgccttgacattctccatcattcttcaacaagaagcctcaggttttcattttgcactgggcctcccaaattatgtagccaatcctatctcaaagccaccatcatcttatgccctgccagtctattctgcttgtagctgccaagagatttaaaaaaaaaaaaaaaaaaaatcaaatcacgtcattcctctgtgtacagccctctaatggctttgcatcttaatcagagttaaaaaaaaaaaaagtccttaaaatggcctgcaaggccctacatgatggagccaccattacctcagcctcttacctcttgcctttgccagtgtgctccagaacacacctagagccatttatgcctgctgttccctctgcctggcatgccctccctccagatatccacttggcttgttccctcacctccttcgggtctttactaaagtctgcctcctccaggaagccttccctgaccaccctgtataaagcagcaacactaagcacttcttggccccagcactcatcacttcttgcgttgtatagatttgcttatctgttgattatatgcctccctctactagaacataaatctcacgagggtgaggactgtttcaatggggtaccattgtgtccccactgcctggcactgggctgccacccagtaacaatgaatgggtaaaggtaatgagagggggagttagggcaggcagggagggcacttcaaggaatataaggtgtggcacagtggctcacacctgtattcccaggactttgggaatcctcctaggcaggaggatccctggaggctaggagttcgagaccagcctggtcaacacagcgagacacagtctcttcagagtttttctttaaaaaattagccaggtgtggtgacacaggcctgtagtcctagctaatcaggaggctgaggcaggaggatggcttgagcccaggaattcaaggttgcattgagctatgattgcaccactgcactccagcctgagtgacagaacaagaacttgtcacagaacaaaacaagttagccaggcatggtggcatgtgcctgttgtagtcctagctactagggaggctgagggaggagaatcgctggaacccaggagttcaaggctgcaatgagccatgattgagaccctgtctctcaaaaattaaaaaaaaaaaaaaaaaggaacatgggcaagcagggagactgggaggggaaggacaggggagtgttggagtaggtctgtggggaataaagtcagagggataaaggagtcattgaacacaaggctgagccacaggggtgccaaggaccctcccagggaccatagttggggaggattgaggggccttgggggagagagaccgaaaggtgaaagagggcttcactgggcagctgatgtgaccccatctgcccctcctgccaggcgccctgggtggtggaaggcagccgccctcccgaaggttggcccccacgtggggaggtggagttccggaattattctgtgcgctaccggccgggcctagacctggtgctgagagacctgagtctgcatgtgcacggtggcgagaaggtacgcgtggggtaggcgggcctgcgtgtgtgttcatgcctgcagacatggccacagcccttgtggggagcttgggtcttttgagagcacaagtgctccagccacatgtttgttcggcctccaggagagtcctggagatgcgcctttgacctctcagcttccccctcagagccccttcccttctccgcccaggtggggatcgtgggccgcactggggctggcaagtcttccatgaccctttgcctgttccgcatcctggaggcggcaaagggtgaaatccgcattgatggcctcaatgtggcagacatcggcctccatgacctgcgctctcagctgaccatcatcccgcaggtaggagcctggcatgggctggccacactcaccaacggccctggaggcaggccccaccttgttctgtagctttaggatggagactgggaccccagtctcagaggcttgggcaggtggggagggacagacagcaggaagcagagccatcagtgagccacccgtcatggatctggaaagctcagacttaccctgcccagtcaggccctgtcctttgacctcctgggccagcacatggggaaggacccctccaagaaccccttcccccgagacattctgccctggtctttttgcgcagctctaattacatttcactttttctgtctcctccggggtattttttgtttctgccgagtggacactttggagtcagattagtggctctggttcctgcttcaacagaggtcttcgtgattggcaaagctgaggtttatcactcccctacaggcaattttctatctctttggccattgtgtcctctggggagctggaaacagagtgggaatgctgccaccttaatccctctcttcttccctggacctggggcctatggctcctcatagggcctaagctgcctccctctgaggccacgttgtatccccaggaccccatcctgttctcggggaccctgcgcatgaacctggaccccttcggcagctactcagaggaggacatttggtgggctttggagctgtcccacctgcacacgtttgtgagctcccagccggcaggcctggacttccagtgctcagagggcggggagaatctcaggtaaacactgggagtgcagaggtcaggaactgcaaccctccctgggaaaccctggcgggtgctgggaaacctgacaccaatgacacagagatgaggccagcccggatgtgcacagggctgtcctttcgtattgagcatattccgtgtgccaggcatggtgtactgccccgccgactcctcacacaagccccagcggtggtccatgatcccacttcaccggtcagggaactgaggctcagagatggtaaagggcttgacctaagttgcacagctgggagaaggcaggtctgggatttgaaccagctctgggagattccaaaaccctttgaggaagccctctcccctccagagctttcttacagccccagattttatgtcctcagccactgggctatgcactggaggggccagtagtcacctcttactgagtctaaaggttggagatacctatacctgtgctagctgtgtgatttggggctagttgcttaacctctctgtgcctacttttctttcactctaaaaggcagataataacagtccaaacctctttgcattatgctgcccaataaaaaacaaagcaagtcatgcatatgaagctaatgtttttttcttatagccacactttttaaaaaggaaaaacaagcaaaataaactgtaatactataacttatttagcccaatatatctaaaatattatttcaacacatcattgatataagtattagaaatattttgcgtttcttcctacaagtttgaaatccagtgtatatttcacatttacagaatgtctcaatttggactagtcacatttcaagtgctaatagccacatggggccagtggctaccacctggacagagcagtgttagggtcagtgtgatgacaggaaaagcgcttcgcttggatgctcctgtaaaatgtcagcttttcccctcctcccttccctccatcttctcctcctcctcctcctcttccctattttcatttttatattcagtccatactcatgcaccctccccagacctcaaaaactaaaacaaggccaggcacagtggctcacgcctgtaatcccagcactttaggaggccaaggcaggtggatcacttgagggcaggagttcaagaccagcctggccaacatggtgaaaccctgtctctgctaaacacaaaaattagctaggcgtgatggcgggcgcctgtaatcccagctattcgagaagccaaggcaggagaatcgcttgaaccctggaggcggaggttgcagtgagccaagatctcaccactgcactctagcctgggtgaccgagcgagacttcgtctcaagaaaaaaaactttacatttgcccagcacttaacaatattcaaagcactctggcctccactttctcctttaatctttaccatggtcctgtgggccagaaacgagcctccacggtttgaaatgatttcctcgcagcagttcagctggtaaggggcagagcggggactctggctctgtcccaaacctttccttgctgtatcacagccacctccctcacctggacaacattccccaaggcccctcattatcccaagggtgggactcccttgccacccacgcagcccttaagactaaatatgcatcttaagtggctctcacttacataaccacgtgggggtggctggcggacaaacatggtctctccagaccctgtgccccatgactgtctcttgcttgatccattcttctcacctgcttgctctcaacacttcccccagagcatgccccaccccgacacatgccgtgatcagagacagaaatcagctcccctcctccctcactgagcttgtagccactttaagtataacctgtgtcctgtgccagttccaccataaatcagccctgagttctatccggcggcttattctgctgccaaaaccttcattagttgcgggaatgggccagggagagagcccggactttactccggctgtggtgactcacgcctttgggaagggctgaggtatttgtccttggatgtggggatgctgtggcctctggttgggaacacagcctcgttttgtctgctggctctggcttccagagcaggaggctgaaggcgtgtgtcctgctcctcctttacctcctcagtgaccagacacaaagagtccccgggtgttcctctgccctgccattttcttgtcccagaagcagagccctggcctgtattccctatggggtgggaggtgactgcctgaattgtgtgatattaggctcagcaagatggcatcgtgtggcctatttgcaaatatccaagaagagccatgcaagtatgttcttactaaggtgtaaatggctgatagagtgaagcagagaaacatcacggcactagctgaaaagcaaggatggggaagaaagcaccgagagaggaggccaagggtgccaagagcagaccagggatttcacaatgccttttagcactggctcattccccaaggcccctcattatcccaatggtgtccagacctctgctccgttctggagggctgggctgtggcagaaatgggagaagtcagacagaaaaccagtcctgggccactgaggagtgaaacaggtctgggaatgaggcccagaggcaggtgggaggcccccagctggaaatgcctgccttctccactcccagcgtgggccagaggcagctcgtgtgcctggcccgagccctgctccgcaagagccgcatcctggttttagacgaggccacagctgccatcgacctggagactgacaacctcatccaggctaccatccgcacccagtttgatacctgcactgtcctgaccatcgcacaccggcttaacactatcatggactacaccaggtgggacacggaaacctgagcaatggggaacctggtggggccacctggggcatcaggaatgggcagggcagattagggttatctgaacaaggcaatgttcctgggattgctagggcatggcaggcagagcagagtttcccaagatctggataaggggcagaccagagtggggtggcctgggctcaggggtggggtatacaatgacattttcatttttcttcttcttcttcttttttttttttgagacagagttttgctctgttgcctaggctggagtgcagtggctcactgcagcctcagcctctcgaagtactgggattacaggcgtgcaccaccacatccggctaatttttgtatttttagtagagacggtttcaccatgttggccaggctggtctcgaactcctgacctcaagtgatccacctgtctcggcctcccaaagtgctgggattacaggcgtgagccactgcgcccagcttcaacaatgacattttctaacacatggggaagggcacactgggctccacaggcactgtctttgtgcacaggccacttgcatcctgcctcctccatgaggcaatgtaaggggaactggaggcttcatgctgagtcccatcacttcctaagaaacctgctggcagagtgcctgcatgtccctcaccttattggtgtctcacagccactctggtcacagatgaagaagcaactcaagtggcagctggaccgtgacagcaccatgaggagctgagccttgtggggagagcactgtgtctggagtcccaggctgctgtgtgaccctgggcaatttgcaaaacctttctgagcctgtttcaaatgaaaatgatgcttcgtgggattgtcgtagtcaatgagggctgggcacagtggctcacacctgtaatctcagcactttgggaggccaaggagggcggatgacttgaggtgaggagttcaagaccagcctggccaacatggagaaaccctgtctctactaaaaacaaaacaaaacaaaacaaaaacaaaaatttgccggatgtggtggtgcatgcctgtaatctcagctactcgggaggctgacagagaattgcttgaactcaggaagcaaagattgcagtgagccaagattacgccaggacactccagtctgagtgacagagtgagacgttgtctcaaaaaaaaaaaaaaatggtggccaacgcggtggctcacacctgtaatcccaggactttgggaggccgaggcaggcagatcatttgaggtcagaagttagagaccagcctggccaacatggtgaaaccctgtctctactaaaaatacaaaaattagcctctcatgtggcaggcacctgtagtcccagctgctcaggaggctgaggcaggagaatcacttgaacccaggaggcagagtttgcgccactgcactctagcctgggtgcagagcgagactctgcctcaaaaaaaagaaaaaagtcaatgaaagatatttaaactgcaggtgatcctgggaaatgacagtgtcctccccagccccttgctctaattcttgcgctaggccctccaaggatgaggggaggggccatgccctcagaagcttgtggcttccttggagaggcagaccactccctcattgtgccagatgtcaaagtgtggtgctggaggtcgaggagagagggctgggtgactcagaagcctcacgggagtgaactggccctggcctggcaggctgtgctccctagaaactagaggggaggaggaggcaggaggctcagacaagtcttctttgaaggagtatagtgggaataccccaacaggccttcactcactcaagaaacacttgcaggacgatggagtgggaagggtgccatggacagggcaatgggtcagaccttgctctcttggaagtgcccccatgcagccagcagtgtcttgggagccaagctgagaatgcctgatgctaccctctgtctgttccatccctctcctaccctcaccccccactcccatttaggaccccactgggagaagggagggtgggcaggaagtgctgagccctgggtttggaggagggacagggctgggctgagaggacctgttcccaggcctaaccaaaactgtttcattcaccagcagccctagggtgaggggcttggatggaccttggaggttgggagttcattcattctagtggaacaggcagaaattaatcaaataatcatgtgtaaatagggcccataggaaggacgcaaaggcctgtgtgtgcaggccagaaaaaggctatccacacagggtggccaggacactttctcctgtaaggaagggatgcaccagccaggcctgaaagaatgagtaagagttggaggatggaggtggggcaataaggtagggagcgagctgaaaattgcaggcaaaggatataacacatgccccaaggcaggagggtacaggaggctggagtgcgtgggagggaggcagtagaaccaagatgggggtggagaacaggccgcactctgctgcactttgaggaccatgggagagcattcagtccttacccaagagcaatcaaaagccgctgaagaccttgattttggagtcagggttgggatcggcgggaggggagggggggcggtggccaggcagtgatgtcacagacacagtccttcccaggacacatctgggagcccagtaggctgagaaccagaatgcagtcagccccctcccatggaggagcacttctccaggctggggagagccccttcccctcctgccgtaccctggtggagccagcccactggccttgtaccaggtgcactcggtgagtggttggtgggagattctaaccctgggctcaggcctagctgtttgtgtgtgagctggagacccaccgagcagcagcagcagcagcagcagccgcagcagccgccaccagatttgcagcccaagccccagattccagtgtcagcctcgctgcagctggtttcctgccgtgtgcttttgtgagccgacacaaagcagatggatgtgcacagagcccagcgcacaggcccatggctccctgcgcacagcctgctgaagtcctgtgaccccggcaaggggaagggctcattagggaaggttttcagagccctgactagcagagatgaataggaccttgtgtttgatcccagaaactgcttcacttgccagaactaacagaatggctaaaataaccagccttgcaagtgtgcacatgtggtgcggtggctgtgttgggtgggttggcatgtcactgtgggcctgagcaagtacccagaagagcaggattagacgatgtgaccaggtcagggctgatggaaacctgaccacttctctcttttttgactagggtcctggtcctggacaaaggagtagtagctgaatttgattctccagccaacctcattgcagctagaggcatcttctacgggatggccagagatgctggacttgcctaaaatatattcctgagatttcctcctggcctttcctggttttcatcaggaaggaaatgacaccaaatatgtccgcagaatggacttgatagcaaacactgggggcaccttaagattttgcacctgtaaagtgccttacagggtaactgtgctgaatgctttagatgaggaaatgatccccaagtggtgaatgacacgcctaaggtcacagctagtttgagccagttagactagtccccggtctcccgattcccaactgagtgttatttgcacactgcactgttttcaaataacgattttatgaaatgacctctgtcctccctctgatttttcatattttctaaagtttcgtttctgttttttaataaaaagctttttcctcctggaacagaagacagctgctgggtcaggccacccctaggaactcagtcctgtactctggggtgctgcctgaatccattaaaaatgggagtactgatgaaataaaactacatggtcaacagtatatacacagtagtctttttgcacttgttcacaaggtttggggattaggatctttggaggaggccaagaggaagactttctacacatgtacatggttgtagttacctgaacttcagacccaagagctcttggctgcaaatattgccttcacagccaaaattccctgggtaattgccagtagctcctgctctgctgtgcagatattgtaaaacggtgagaaaggccctgaaatctgacctggggcctcttgggaaagctgctgtgaacacctccacgttaatgtcatccctcagccctctatgcctgtttctctagggactgagaagtgcatgatgcttttacttccttgctcatttcgaagtctgttccagacagttcctataaccagtgaggcctccaagtcattcattttcctcagtctagccaaagctgaatgtgtgagcacaaagaagccgagaggccacctcctgcccagagagaagccacccacactcccaggttggcagacaagatgtgaggggtgaattaaatttgttttcttgagcaagcca

SEQ ID NO: 29 - DNA, 59859 bp, homo sapiens
gttataacttttgtaattgtctcacacccacagtacgtgggtattctgttccatatttttcattttttttttttttttgctttgcatttcagttttagaagtttgtactgacgtatcttcaagcttacttattcttgccttggctgtatccagtctattgatgagcccattaaaggcattttttcatttgttctattgttttttatttctagcatttcctttctattctttcttagagcttccatatctctgcgtacattacccatgtgttcttgcatgttgtccactgtttccttagaatccttggcatattaatcatatttatttaaaatttttggtctcaaattcaaaaatctctgccatatgtgagtctgattctgatgtttggtttgtctcttcagactgtgttttctgtcttttagcatattttgtaatttttctatcattgttgtcattgttgaaagccagacatgctgtatcagttaaaaagaacttaggtagatgcgcctttaagtgtgaggtttcatgtttatctggcaaagaggtaggctttgttactgttcgtggtgtcagaggctaaaatttcctactgtgtccttgtttttgcttcctatgttgtctttggctgtccccagagactcttaaaatagggtctgaggtttgagttcttttagctgtaatgccccgttattacacaggagctcttctgatgtggtgataaggtgagggggagaggaggactttctgcagtcctatgattagggctcaagtcttttagtgagcttgagttgagtatttcccttctcccctgtggaaggctagagctgaccagagttggtaatttcccttcctccagattggttagcctttggtagattcatctggttaggctctgatagagagtttcccttgaggccaggtcttgttaagaagaacagagagccctgagagtatttcacgatggttacttaccccttctccctggcaaaagcaaagcagatttttctcagatctttacagtgagaatctgacaggattcacagaggtaaaactgaggtaagtattgaggcccctctcagactgagcctccttggagttttttaactctcaagctagtctgcactgagcctccagcaattccccaattacagtttagtgttcctactgatgttggctccagctgtgaaactagcttcagcttctggcttctgtgcctgggctctgctcctggtaaactgtgattctctgaaaagctgtgattctctgtatctatctgtctgtctctctagtttttagggcagtggtttttcctgtgacctcaattctctggtggatctaagaagagttactgatttcagtttgcttagcttttttttttcttgttgtgaggatgggagtgacaacttccaagctctttacatgttgaacaggaaactgaaagccccttggtgttcctttgtaaattcatcttaaaaatatttatcataattgaaaagtgctaatatcaaattttcagtctgtttatattccccctaaactcagataaatatacattttattttgtgtgtctgtgtgtgtgggttttgttgttgtttgttttttgtgtttttttttaagatatagggtcttgctctgtcaaggctggagtgcagtggcacaatcgtacatctctgcagcctcgaactcctgggagaaagtgatcctcccgctttagccttcagagtagctacgactacaggcactaaccaccaagcccagctaatttttaaaattttttgtagagatgggagtttcactttgttgcccaggctggtctcaaactcttggcctcaagtgatcctcctgcctcagcctcccaaaatgttggaatcacagatactttgtgtcttgattcttgaaaggaaaaaacaaagatttttaatgcctcttatcttgtacgcactttccttccaaacaatacccttttgctgccattgttctcgttatgaatagcttaaagaaaaagaaacaactaagggtagtaataggccaggaatcacttactgaatactaggtcttcttgtatagtttgataccctataaattgtgtgcatctgatgcatttcaccttcaaaaggctcaatgctctgtattatttagtagtaatcaaaatttcaagttttacttaacctcctgattcactgcccaatttcctaataaatacgggctaagggtcaatggggtcatttgcaagtaatcttgtagtctactcagaaagttctgcaaagttagaaagtgattaaatgactgtttgttaagatatacttacatagtaataacctaaatgcatttgttaagtggttgtagagagagggatttaaaattttatcctatatgaaattttcctttttggtgtctgttatttaataggattgtttgaattaggggatactatttggtgcctttgtaactatatgaaaattagttggttgaatattactgctttccatgttcatatttatatttgtatagacatatatatatatacacatatactactttcctttccattttcatatttatatttgtgtatacacatatacataaacatatattttatacatttttgaaaaggaaaattaacttaagggcatatttaatgaatattcaaaaatttttttgctgatcaaattatcattctgctttaaacttttgaaatgatccaaaaaaattttaaatgacttagatttactgttacaaaatgcttgtcttttgatgtcacaaacattatatactataatcactggccagagataattgctataagtataatgaaaagggaaatgatggaagatctctgcagctatcctcataaatgagggtgggaacacgatgggcagttccaaagttgaaaatagagaatatatgtggatttatattaacataattggtattcttggatagttaaaaatggctaaactgtaggagaagcccgagtaattactgttaacagaggaataaatttgagggcaataataatgatgataggccaggcactgtggctcatgcctgtaatcccagcactttgggaacccgaggcgagcggaccacctgaggtcaggagttcgagagcagcctggccaacatggtgaaacctcgtctctactaaaaatagaaaaattatccgagtgtggtggtgcgtgcctgtaatcccagctacttgggaggctgaggcaggagaatcacttgtacctgggaggcggagttgcagtgagccgaaatcgcgccactgcgctccagcctgtgggccagagcgagactccgcctcagaataataataatgataataataataacgccaccaacaatactaagagctaacatttactgagtgcttactatgcaccagatattgttctaagtatacatttattatctcatttaaccatccataatactgtggtatagacacttttatatccattttataaataagtaaactgagttatggagagattaaacgacttgccagtaagattcaaagcctgtgtacaagctcacgcttgattctggagccagtgttcttaacacagtatcttgagaatgttaaactaaaaagtttttaatttacagtattctttccacaattaaaaaagaaattatgagtaattatttttagttctttcttctcttcaggcatttcccatggttcttttcaagacataatacatatcatttagtgttgtagatctgaaaaaacaaaagtagcgtgaagatcaaaaattttctaaagagacggagtctcgctacgttccctaggctggaacacccaggcttctccagcctcacacctctgagtagctggaaccaccctgtccgctaaggtcaatgtttaatcgtatctttgtaggtctactgaccagttaaaaagaggtgctgtatacattggttgttgtcttgtcagagtttgatgcttctatatagaccattgtttttacatgctaatacaattgaaagccactacagatatttatatttacaacccaaagctaggttttaacaagaaactcataaggcaaaggtgagaagtaaaataatttagcgccaagtggagatatatgtgcaatgctactttgttgggctcaaaacatatttttcttttagaagactgacaggcttgaagtttatgcctccaaagacaaaagtgattatgttttgtttagtagcttgcaaagttgccaaaggccattttttctactctttccctgaaattggtttatatgcttattaaagtcatttatacctatttgcaaatgcttaacatagtttcagattttaagatttccctgcaactttatttcccttgaagtttacagcaacaggagttcatttttatttttaattgcatttattcagtaagtaaactccgccacagaaaaacttagtagacaaggtgagttcccctgtgctccgtggcaaagagtgcggtgggtgacattgacccatggttaggtaatctggtaaggaaagaccccgttgtaacacatctgagcaacgagaccaaaggaagggcttgctgccacgaggcgaagtctgcttttttgaacagagagcccagcagagttgggcggcaatcgtgcccagcactgaggccgaggagaaagagagcaggagcattacattactgcaccaagagtaggaaaatatgatgcatgtttgggaccaggcaaccgaaatcccttctcagcagcgcctcccaaagccgggcaccgccttccttcggagaaggcgcagagtccccagactcgggctgagccgcacccccatctcctttctctttcctccgccgctaaacacagacgagcacgtgagcgtcgcagcccgtcccagctgtgcctcagctgaccgcctcctgattggctgagagcggcgtgggctggggtggggacttgccgcctgcgtcgctcgccattggatctcgaggaacccgcctccacctcaggtgaggcgggcttgcgggagcgcgcgccggcctgggcaggcgagcgggcgcgctcccgccccctctcccctccccgcgcgcccgagcgcgcctccgcccttgcccgccccctgacgctgcctcagctcctcagtgcacagtgctgcctcgtctgaggggacaggaggatcaccctcttcgtcgcttcggccagtgtgtcgggctgggccctgacaagccacctgaggagaggctcggagccgggcccggaccccggcgattgccgcccgcttctctctagtctcacgaggggtttcccgcctcgcacccccacctctggacttgcctttccttctcttctccgcgtgtggagggagccagcgcttaggccggagcgagcctgggggccgcccgccgtgaagacatcgcggggaccgattcaccatggagggcgccggcggcgcgaacgacaagaaaaagtaagcccattccctcggcccgccgccttctcccccggcgaccccgcccgcctgcccgccctgggctcctgggccggcctcggcgttaatgggattggggggggcagcctttttgtttctgctgctgctcccctcccctctcttcccccaacctcgccggccgggctcccccgctgtccacgtcgccatcttgtcgtggggggtgggagacgcctcgaaagtgctttcaggggccggggtctgagccctgcttgccctccccgccggccgtgggggcctcgcgccgcccacctacccgcctcaaaaacccagcctgctctgtggccccatccggaggggactttacccagcctgaaaaccccgggaagagaaatgagctgcagctcggtagccgcggtttgcacccggagcttccgctccttcccgcccccatcctctccagttccattgaaaactcggccctggggcggaccctgcacgctggtcctggctttccagtggacttggggccttgagttcccgactgagggactcgcgtggtcggatgcgatcttgtcctgtagttgtccagccgtcgcgggtgtctttgcctttgtgcattagggatttgccgcgatggccttaagatgcgaactttttagtttgcacgtgcaggttttgtttcgttttaatcgccttgaaaaacttgcctagactgagagtcagagtaatgggaatttagggaaatggcaacattttaaagagaacttcagaattggatacttgagttcatatcacctgtcacgagaacgcagatattataaatgaatatatgcctcattcattcttcaaataatgaaaatgtaggggctggttaaatttaggcagttttaatgatactgaaaaaagtatatgatgagtgaatgaaatgcggcactaaaatgttgcaaaaattttcgaactctgtctcattttcctgaaattgaagtatattaaaggaaaaccgtcaacatatatctaaagtaagtaatcactcggttagaacttaatgcaagttttataaatcaccttgaagtttgagtctaaggggtacattagagattaagaattgtgagttggaccagtggtgttaagagcggactcccccatcccccaacacacacacaattttgcccactttggcattttaacttttaaggaaatcacttaaggaattgaagatttagagtaagagttttggttagtagactggctttgctgttaaatccttccactcttctggcagagagattaatttccctaatcagtatcagcagaagataaacttgtttatattcctgctgttttgtagatcccttctcctggtccttcttcaatagaatattaaattcttagtttgtatacagcagagaaggtcacttataaaattcaaaaagtgagcaaacaggtctagattaattccaagagttaccaggaattaattgcagtttattttgcggaggtgattacagtgcttttgatgaaatgataaagctgctatattgtaaacctaaggcagattacctctgtgtagtgccagttttctatccttattatatattgaatcatacttaatacaatgcattaaattatgtaccactttttttatatacagtatcgaactcattgttttgccattcatccgttcagaatatcagaagcagttttgaaacgaattaataaattagctactgttcatcagccccaattctaaataagctcttagattttcctcagcccatctgttactttcaaaattttctcatttgaaaacttggcaaccttggattggatggattcatatttcttagtatagaagttcttgatataactgaaaaattaagttaaacacttaataagtggtggttactcagcacttttagatgctgtttataatagatgaccttttctaactaatttacagttttttgaaagataactgagaggttgagggacggagattttcttcaagcaattttttttttcattttaaatgagctcccaatgtcggagtttggaaaacaaatttgtctttttaaaagaaggtctaggaaactcaaaacctgaagaattggaagaaatcagaatagaaaatgggtatggttatgatactgtagatttaacgcaggacatttcatgttgttcctagttataggggctgaacttatttaatagcacgtgcattttgatttttagatttttaagggaatgtcaagagagtaatgattctgtttcaggcttcaggccagactccttcagagttttccaaaacaaataattactgaatcattaaagtaaaatttctgagaatagatattccttaatttccttcattaactttggccattaaaagtcaagaagctctctcatttattagcaaacttttctccttatgattctattttgattgtccttttgtttgaggaagcagcatatggtggttaagagcataggatctagaggcagatacctctgagttaagggtcccagcccttcacttgtgagcttgagcaagttactgaatgcctctgagcctctttcctccttttgaaatgatgataagaatagcagccatctgagcagttattgtaaaggttaaatgagataatgcttgtgaagcacttagcccattgcaggagtcttgatgacactgtgtacttgaaaatagatgttacctgttaaaattcttgtttaaacttccacaactcttaaaactcttttttgctagtccttccagctgtttcctttagtttcttttctgtgtcttcatgcatcttttctatctcctgaaagtgaaaagactaacattggatccagagcttgaaaagcgtttttttcctgttacaatgggcaaaagagtacatccttgggttatattggcacctagtatcagttatttttcttgagcatctgatctgctctctactctagtggaggcctcctgcttcacaattgctcacccctgtgttttctccccaaatagaatactgagtttactctggactctagagtcaaacatacacagtattctagtcttactgttcatttaagcaagatatgtgcaagacactgcattcttagtactggcagtaagttaaaacatttttcgtcttgatgccaaagtttagacaattttataaaaattaacctttgtaaaagataatgagttgataaaatattctcagtaaagcagctacgtggtagaaaaactgtcctttgcttatgagtttctccagagttaagaccattgggttccatctgaaggcaagacttcaagcttgtcttactggtctgttttgtggctcaatttgtatgaagtctatgcactcttccacacgtgtgtatttactgaactatcgagttattttagactgagaaagtattggagttcattcctacggtccactgcagagcaccttgtgcagtttggagaatgtcaacttttctacctgttaacttccattgtctttacttttaacgccattgtctgtgactctaatggtgtcacggctcagggtttagattttgtggttacattctattcttgtatgtcaagagtggtgtatagaaagctgagggggattatttagtctcttgactgattttttttttttttctgaagaactcagtttattatgtttggtggtgaaataaaaattgatgtgcatggatgttaaagatttgggttaaattgtgtgttcatagatgccttctcttagtatataattttttaaatttagatacttaaaatactgtatccctttatctaagattaacataagtctgtttcttaaccaggataaaaaaatctaaatttaaatgtgatgttggatgagtttccaatcaagaaattgattttttaaactttgtgactagttatccagtgggtggattttacccagtgtgtgtatgtgttttctgcttaactctggaaggttagaaagagaatttgaaactaagacaagccaagcttcttgttgctcagtatttttggtaaaaatatggtcagattgtttaaattaactataggctttggaattttaaaaataattatatctcttggtctcttgacacatcaagaattaactgttttgtatatgcgttgagtattaatgttcatgttttctgcagtagaaatttataaacccttatttatttgccagacatgatccctttagagaaatctagtatctaaaacctgaatttttaaaacaaaatttaaaatttttgtttcataaaaacaaaaatgtgattacctcatggcttttttcttatagcttttgattgttttttaaaatcgtagttcaaaaacattaacctaaaatttaccatcttaaccatttctaagtactgttcagtagtgttaagtatattcacattgtgccactaacttccagaactttttcatcttgcaaagctgaaatcttacccattaaacaactcccaatttccccctctcctcagcctctggcaaccaccattttactttctgtttctgcaaatttaactactctagatgcctcatataaatagaattatagggttttaatatttttgtgatgggcttatttcactttgtgtaatgtcctcaaggttcatccatgttgtagcatgtgtcagaatttccttcctttttgagtctgagcaatattccattatatgttccatattttgtttctccattcatccagcaacggacacttgggttgcttccacatcttggttattgtgctgctctgaacatgagtctgcaaatctctctttgaagctttcactttttttggatacatatccagaagagggatgctggatcatatggtaaccctttttaattttcaaggaaccaccatattgttttctatagcagttgcaccagtttacattcccaccaacagtgcacaagggttcctatttctccacatccttctaaacacttgttttctttctttccttccttctcttctctttctttcttagccatctaatgtggcaaagtggtagccatctaatatgttgaagtgattgtttttaagggcttgtttgtggataattaaccagctgaaagctaactacagtttgccagtggaagctttaactgaaaggagagtaagtacctctaaaaggagaattcaatttttctagtgacttagatttgttatgccagtactttttcacagaaacactttttgggtaaaatagtgtacacctgttctattgttgataaagcccaatttaattaggaaatttgttctctaagatttaaaacaataattgaaataatgtatttttattaaaaactgttcccaagatgttagcttttagctgttctggtgatctcaactgttatttatgagtgtttctttattttaaaatttcaccttaaccggttacagttttaaccataaagattatttcaacatatgattttgaaaatttattatcttgtaaatgggaaaatgtagtgatggaacatagtttactgtatgtagttcttcacttgtttgaaaagtcacaatatatttaggcaaattaatttaaaagtgtctagtatttaatattgcaattttcactcattaaggacaggtcccccgtgtttcccccttttttttttccaagtagtttgggaggatttgtttttccagctgaaaaatactatggttaaaaataaggtttaaaggcgaaagttgaagtctttgagggttgggatacgtttctgttcttaagagtcttgtaaattcagatgctaagcaaatttctttaaaatgatttctaccctccccctttccattataaaactggatatgtttcagtggaccaaatcccaagtaggctgaatttgaaatttgtgggctgggcgcggtggctcatgcttgtaatcccagtactttgggatgccgaggtgggtggatcacctgaggtcaggagttcgagaccagcctggccaacatggtgaaaccccatctctactaaaaataccaaaattagccaggcgtggtggcgggtgcctgtaatcccagctacttaggaggctgaggcaggagaattgcttgaacctgggaggcggaggttgcggtgagccaagatcgccccattgcactccagcctgggtgacagagcaagactgtgtttcaaaaaaattaaaaaagaaatctgtggtgtgaatactggtacgtggtgtacacagtgagctcttaataagtatttgaattaacaaatgagacaatgattgaataattggatgaacaaagagaatgcaggtttttaaaaggtttctttagaaatattgtcggcccggcacggtggctcctgcctgtaatcccaccattttgggaggccggggcaggtgaatcacctgaggtcaggagttcaagacaagcctgaccaacttggagaaaccccgtctctactaaaaatacaaaaaaaaaaaaaaaaaaatagcaggatgtggtggcacatgcctgtaatcccagctactcggaggctgaggcaggagaatcgcttgaacctgggaagcagaggttgcagtgagccaagatcgcgccactgcactccagcctgatgacagtgtgagatgctgtctccaaaaaaaaaaaaaaaaaattaaaaagaatgttttaattctttagttccctgtctgagattcactgattggtaagaagaaagttaaagaatctcctttgactttttttgatatagatatttaaattctattactttatagtaaggttggggtttattttctttgctttataatagaagagcattgattattctctttgctttataatagaataccatttaaataggagttccctgagtgtgtttacaatcatttgatctggctaaactattttaatgttaatgaaattttaaaattttggaggaaaaaatttaaaaactacacaggtgcacaaagaaataaaaatcacctgctttttcactatgtagagaccattgtctactatttctcaattctgtgttacatctgtatgttaataactgtaggattagggactgagtactgtttttaacctgcttttaaaaaatttacatctacattttttcccatctaaatagtgaggaagagtatcagaattttgtaggcttgtggtgatggttaaattagataatattaatgttgggtacttaacataatatatggctcttaatactctccagatttcagatatagtctgttttaccattactgcctttttatcaaacctattctcaaaaaagtgagaaaagtgctgagattacaggcgtgagccaccatgcccggcctcatggttctttcttaataataaattagaagaagtagaattacagggtcaaaaagtatccattttaaagctttcaatgtaattgcctgtttatcttctagaaagtttgacctagttgtattttagagtgtcattttcttgaactttatcatcattaaagttttaaatttggaacactggcaatttgataagtatattaggattcttcttattgcaagtagcaaaatacaactcaatctagtttaagaggggaaaatgtagtcattggctaacacaatctaattttggtttaagagacaaatctagagtctcaaatgatctcagagtgtaataatccctgacttttgtcttgatattacttggcttgtatacctttgctctatttgcatgctggccttactctgccactgacaggctgtctgtatggtgtggaagaggacggctagcatccccatacctgcatccatacagtttgtaatataaaaaaaaaaaaagtaaaaaaaactccctctctcttctagtgtctatatatcagtttcctagaagaaaacgttttgccctacttggccatgtgaatggagttccctgattacatgagtcaaatatgtcttattgtagcatatttgatggtcttcttgtagaatattatcttactatacacagaactcttgaccagtaattaatgggccatgagtttttgttgcaagtcatttgaattcatattctatagttttctaccaagtgtagtcattctgcaagctgttcttgtcatgacttttgggaagttgagtatttcttctatgggttagggttttcatctcaagaaaaagatgatccttttctctactaaatatgtgttaagatcacacatttttctagatcgtttagctctactgtgtgatcttacacaaattgctttattgggatgataagaataattgccttataggattgttatgagaatgaaatgatacatcaactcatatgaaacactcagaacagctcttggcacaaagtaagggcttaattaagtagaaactatccatatattcataatattatagtattggttaagttgttttcaacattgtttagaatcgctcaagccttctttgtgataatctgacgaaggctattcaccaccagtgagtaaataatagtggcagaatagttactgatgcttttcctttacttggttttttttccataaacatctggcctttgcagactaaatactggtttatgtatagacatgttattctaaaataattttccatagtggtaatactaaaggaagaaaaatgttctcaaagctatttatttgggatgttaaaggagggggaaattaagaaagcctacatttccatgtcctttgtgtccagaatctcattaaatgtcttttaacttgttagcagaggaaagttggatattgcctgcctttgtagctaacatagttaaaatatttaaatggttatagtgtcaaaccagtagtcaaagccttcactgtgaatggatgaagggatattttcttgaataatttaagttgacttatttcagtggttcaaaaaatttcttcaacgcttaaccatgactcaggcacctaactattatactatgtcctgtaacagattgttgtgcattcatttattcaacaggtatttgtgcagctaatttattgagtacagcattgaatcgttgatggcttaggccacagttgaacattccattttttatgttcattcattcattcatagcatattccatttttaaattttcagttcattgcactttaaagtttgaggttcttgcgaagtacagacttttgggtttaagttttgttatttaatgtcaaccaccacaggcgcattggccagtctgcttttagaattttcagacatacatacacaaaacattctcacaagacaatctacttattttcttttttattcctgtgtttcttaacacaggattaatgttcagatctcttttggagcaaaataatcctctgaatttttgagatgtacccagtgacctcagtctgagtatgtatactgcattaaaaaatgtaaccttgttccttttagtggtcatttggtaacagtttgatcataaacaaatgcagcctcaaacacagaaggcttgaggcaagtatacagaactatggagagatcatttagatgatgtagaatatgccttttctttttttacaatgccaccaaaatgaaaacacggttttaaaaattctcatagagtgtaacttcaacactgctttaactctattaaacaaagcactgccatgttgtaattcctatttattactctctggagttgtataaattaccaaatccgccttttgtttgatatccttttcaaatatctgagggtagctatcatgtttcttccttctattcttaaaaaatagtcccaaatttcttgaatcttttaatttaaaaattatatattgagcatctgatttgtggaaaggcataggccatattaaaaatggggcttcatattaaaatggggaaaagggtggagattctcaggtggaatctgagatctgccacacactaatagtgttacctaaccctttttaaagacaaagaaacaggatcagaaggtcactttggaaaatttatttggtaatattggataggatggattagtatagttggaaaacagagactcttgctttaggagagctgctcctttgtcatttccagaatcttaatcatggtcaaggtttagagctaaatatttaatagaagaagtctttagggtatgctttctattgtacacccttatttcaatacatgtgttttttcctgttatgtaagtactttattattatttatgcatcttctattaaagttaagcaaataattatttcaaggacacattcttctacatacacacaaagtttagggtcactgaccttcttaggttctagtcttagatctgttaccatctaagagcatataaataagggaaacagaaagaaaaggatttacaagctgagaaggaagcaatgcagagaaagaagagtgatagagtaggtaatttggggaaagtcagtgatacacagctcttaaccatgaacagtgattcttcactcttgaatgtttgtgacattcatgaaggtattaaaagctgacttttaaaaaattgtttcagagaactggaaaaaaattcagttgccacattcttccttaggtcatctttgaactctactcatgcacttacgtgtttaaggcaaagttttactaaacgcacacttgttcttgctggcttattgacttttactgctagcttcttattcttagcaattatacctcacattacatagtattgtgaaactcactatattcagtgttttgcctgacaaacatggtatgttataggatgtgtattcagttatagctaaaaataaattattctcgtttttcaaaatttgctggcctacctgttaagcttttgctttaagacctgctaatgtttctcaaacttctgtggttaaatcacctgagtgtctagttgctctatggattcccagggacccattcgccagagattctgatttggtaattttgggatggaactcagggatctgtaaattttacaagcactcagaaatgaaacatagactttaaacagctaagagtgctcatcaggattatgttgatattattttttaaacagatgtgccaagcctttaatttgaatttccagggttgggatttggccttctatatttgggggaaaaaagttctattgatgattgtggatatataccacaggtcaaccattgaatagtctagtcagtgtagttagtgtattttataattactaagttctaagtatgtggtgtattaatgtcttaggaggtggatatatttcctgtatttgtaaagcatttgggtaggttttttaaagagaaaagtatgtaacaaactagttttgagcgttgctcttttacttctttgggcatttttgaagaacacgttaagtatcttcttagagcagaggggctcagagtggtccccagattatcatcattggtaacacctagttggtgcattactaacttgttagaaatgcacattctcaggcgccattcagacttcataaatcagaaactctggaagtaaggctcagcattctgtgttttttttttctttattatactttaagttttagggtacatgtgcacaacgtgcaggttagttacatatgtatacatgtgccatgttggtgtgctgcacccagtaactcgtcatttaacattaggtatatctcctaatgctatccctccccgctccccccaccccacaacaggccccggcgtgtgatgttccccttcctgtgtccatgtgttctcattgttcagttcctacctatgagtgagaacacgcggtgtttggttttttgtccttgcgatagtttgctgagaatgatggtttccggcttcatccatgtccctacaaaggacatgaactcatccttttttatggctgaatagtattccatggtgtatatgtgccacattttcttaatccagtctatcattattggacatttgggttggttccaagtctttgctattgtgaatagtgccacaataaacatacgtgtgcatgtgtctttatagcagcatgatttataatcctttgggtatatacccagtaatgggatggctgggtcaaatggtatttctagttctagatccctgaggaatcgccacactgacttccacaatggttgaactagtttacagtcccactaacagtgtaaaagtgttcctgtttctccacatcctctccagcacctgttgtttcctgactttttaatgatcgccattctaactggtgtgagatggtatctcattgtggttttgatttgcatttctctgatggccagtgatgatgagcattttttcatgtgtcttttggcagcataaatgtcgtcttttgagaagtgtctgttcatatcgtttgcccactttttgatggggttgtttttttcttgtaaatttgtttgagttcattgtagattctggatactagccctttgtcagatgagtagattgcaaaaattttctcccattctgtaggttgcctgttcactctgatggtagtttcttttgctgtgcagaagctctttagtttaattagatcctatttgtcaattttggcttctgttgccatggcttttggtgttttaaacatgaagtccttgcccatgcctatgtcctgaatggtattgcctaggttttattctacggtttttatggttttaggtctaacatttaagtctttaatccatcttgaattaattttagcataaggtgtaaggaagggatccagtttcagctttctgcatatggctagccagttttcccagcaccatttattaaatagggaatcctttccccatttcttgtttttgtcaggtttgtcaaagatcagatggttgtagataagcggcattatttctgagggctctgttctgttccattggtctatatctctgttttggtaccagtaccatgctgttttggttactgcatccttgtagtatagtttgaagtcaggtagtgtgatgcctccagctttgttcttttggcttaggattgacttggcaagcattctgtgttttgagaattcttccaggggactgtgatgaaaactgacgtttgagaaccttcatcttagagtaaaaactttacatacacatttttgttgttttatttatctagcacaatacttcttttttttgaaatggagttttgctcttgttgcccaggctggagtgcaatggtgtaatctcagctcaccacaacctccatctcccaggttcagttgattctcctgcctcagcctcccgagtagctggggttacaggcacgtggcaacatgcctagctaattttgtatttttagtagagacggggtttctccatgttggtcaggctggtctcgaactcccgacctcaggtgatccgcccacctcagcctcccaaagtgctgggattacaggcgtgagccactgcacctggcacaataccttatatataatcagggctcaaagatttgttgagaggctcaacaccaattctggaccaggaaagattttatttatatcactagtcaggaataatctaaaaacaaaaagcacattcttcttacaagtaatatttcaatacacattaatgtaaacacatggaaaagtattagctacttaataaattaacatgtaaatgaaaaatttacacattatggctatttcagatgtgatatagatttcattttcagaaggaaccctccaatgtaaaacagtgattcttttccccgtttattttactgcattagaaaatcacatttaaagtaagcattttggtgaggtttggaaggtgaataaatccatcttttctttaattatggatatttaagagagatgttgttgtgccgtttagataataatgatctaaaccaagaaatttagttgctttcaaaaataaaataagtgtatgcattctgaacatttttctttagaaacaaaccatttcatctgtttttttgaatttcaaattaattatacagaattttcaaaatttgaaaattaggttagcatgagaaactgaagatactgaattatattgcctgttcagtctatacttttctttaggatatacagtaggaaagaaatatgatagttcaagttagattactacttctttcagagttttttgacaaatgcaggtacagtgatagtgtcagttcatggtgaatttttgttaaaataaattacaaaaaatttgtgatcctggtatcttgaaactagttaatatttgtaaactttgctaacactgtatatcactgtattctggttttatctgtgcatctatgagttatatgtgtgtatagctacatatgtttatatttatacacatacattacacacaggagtggaatcatactcaattttttttgtatagcctgctctgttcatataatactatattgtagcatctagtataagcaaagattaatttttgtagactttgcttttatcctgaaattttgtggtagctggtttaatggaaagacaatttctgtgacgtgttttgtcagttagggattgaccctggtaaaatattgctggataacaacaagcaatgtaaaaatacatttgttccataagataacctccgtgaaggtagagacttggtctgttttgtttattgcaccgtgtcctgttctgggaagagtgttagactcatagaagatgatcaagaaatattttttgaatacatcaataacattctctaacatgtgggtatcctaaaggtttatttttaaagtttattgattagaattcagaagatattttcccagataaaataatagattgctagctgtcttgaaaatgtaatttatatttaatttgaaatgtcaggtttttgctattttttccattaagtagagatagggtttttaaaaattacatgtgatgttttaagtattctggttttgcaacaattactagatagaaaatgtaacaacagatcctattaataatacttccaataatacatataaaatacttgtctaaaagtaaccctccttaaaaaaacaaagctggccaggcgcggtggctcacgcctgtaatcccagcactttgggaggctgaggcaggcggatcaagaggtcaggagttcaagaccagcctggccaacatagtgaaaccccatctctagtaaaaatacaaaaaattagccgggtgtggtggcaggcgcctgtaaccccagctactcaggaaaatcgcttgaacctgggaggcggaggttgcagtgagcggagatcgcaccactgtacttcagccttgggcaacagtgcgagactctgtctcaaaaaaaaaaaaaaaaaaaggcaataggattaggtatcaacttaatgaaaacttcgtgacagcactttcttgaaaaagactgtggaaaccaaagttagtaaactcctgtttctgcctgggttcggaaaacataaagatgataaagatgtttaagtattcctttttttttttttttttttttttgagacagtgtcttgctctgtctggagtgcagtggcacaatcacagctcactgcagccttgaactcctgggctcaaataatcctcctgcctcagcctcctgagtatctggaactacaggagtgcaccattacactcggctagtaatttgattggttaagaacattaactataactcacacattttcctgaccacatttgcttaggacaaaacagtaaaagacatgagtgtagatgaaagcgataagggaactaatcttaaacactgaacctcttttcagcaaattggctttctagtttctcagctctctctttacacctctaaatctctttcctggcaagatcatttatttgccttggtttatggtgatactcttcattgttatactggtgggtgattgttttaattgatagctgtttttttctacttcaggaagatgacactgctggctctgctggctctgatgtttaccttgtggctaatgcctgtgtttgcctgtgttcacatttattccacgattcatttgttaacatttactaagctgcttttctgtgccaggaacttggctagataaataaatggttgtttttgtacacagaattagctgtcataatcagttactgtagcatttattcttgcaaaaatatatatttatacttcaactagtgatcgaatctcaacttattaattcatacattcagccagcacataattgaatacttcttatgtgtcagaaactgttctaggtgcttgggatgttcattgaacaaaatagacaaaagtctccgcctctatggaacttactttccagtgaaggtgtggattggtgggatagaaaataaaataatcaagtaagatatgtacttaggctttcataaaaatacagcagggcaagaggaccaagatggaggcagtgatcagggaatctcaatgagggtgagactgcgacaaagacttgaaaaaggtggagaagcaagccttgtgggtatttagggtagcagtagtccaggcaaggggaacaactagtgcaaaggctctaggaggcaatgtgtttgaagtgttttaagaacagtaaggaggctagtatggttagaacagaatgagcaaagggggcaaagtggtagaaggtgagatcaaagaggtaatgaggccattgtggaggcccatatggactattggaagggctttggcttttactctaaatgaggcaaaaaccattttaagcagagaggagtgatatgacttgatttcttgttaaaaggattattctagttgctgttacagaaaaagattacaggggtgcaaagaaacagggagacaaaagaatataagattttcactgtaacttatatctagtatgcttgcttatacttgaaaatgcatatccagataattgtagtaaattcaaatattatgtttatttaatagtactaacattgatatgctggttaattatgattaggagcactaataaagcacaaatcagggattcccaaaaagaatgttgaaagggcagtcagcttttcctgtgccagaaatcaaagtcatagcagatttggggcaaatatgtcaaagtcaaacttacgcacatcactactgagaagacaaagatgaatgtgtgacagtttcctgcccccaagaatctttaagcattgtgaaggaagattaatatagccaaataactagagtgatcagttctaccagagaggaccagttttggaagccagaggaaaaaaaaaaaaaacagaaacaaaatgatgtttgaattaaatctttaaaagtttctcttataaatttaccaagccacatattgggaatggtaccccaggcagaaggagtagagtaagcaagccagaaaggaaatactatggtgcttttgagtaactgcagtgtggctgaagaatgtggaaaatgatgaggataaagaggtggacagggaactaggtaagggagggcttccttttaaataattagaccttgtcctgtgtacatttaatgggattttaatcaggccataatgccaaatttctttacttcggaaggatctttatggtgatggtttcagaaagaaattaaagcagagtaacagtggttagcaataatgatcagctagtggttcccaaacttacgtatcatatgcatcttggaagtttttaaaaactcagattttgggatcctgacttagatctactgaatcagaatttacagattcaaattcccagtgaggcctaggaatttgaaatgttgaatgtccttcacgatgcagctagacaagcatttgggaataaagcattaggtgactatttcagtagactaaggagtgggaggccatttaagctcaaaggctattctacttctcactatatttctagtacctagcacagtgcatggtacttgatagatgcatcctttctcccatacctcgccctacacatctcttcatgtgtatccttattaatatcctctattataaactggtaaacatgtttccctgagttctgtgagctgctccagcaaagatgggtttgtgagaatcccaacttttgaagcctgtcagtcagaagttcctgaggccagacttgcaactcctgttgagggggcagtcttggggactgagccctcaacctgacactgtctccaggtagatagtgttagaattgaattgaaggacacccagttggtgtccgctgcagaactgattgctcacctggtggtggagagaacccctcctctcccgatagggttgcagaagttgtcttctgtgttgttgattgctgtggtgtgggagcagaggggggaaaaaagctgttggagagttttttccaaaacaataggagattatttagatttataaaaatagaatcaaagtagattaactgagcacattgtgaaatatagagtagagctgtgtgtaaggagtatatcttaatgtcaagctgacaccaaattgaatgtttgctggaacgttcaaaaatctaagcttcccaaatctgtgaaaacactcaggttagtaaacagtcttatgcaaacagcaagacaatgctcaaagccatttaaggaaaaagaacagtaactgaattctcttatggaaatgtgagatgttgttttagtaagtactgatggtgttatactttttgtttattcgtttgctggtatttcagttcctaaaattccttcaaatatgctgcaaaatacaaaccaagaacttggtggattttccatttgttttcctgtgggaaatgatggaattaaaaaccttgaggattagaccttgagagttaccttccagtgtttatgccaccattatacaaaattctggaggacaaaacccttcccacttaaaaaccagttagtttcagaaaatcacctcatgttaggagactgcatcattatagtatgtgtgttagctttaggtatagatctaaaatatttttaatattttaaaaacttaagcctttcttcattaatttggcctaatacaagttagaataactttaaaaatgagtacaaacaacaaggaagggccaggcgcagtggctcaacgcctgtaatccgaacactttgggaggccaaggtgggcagatcacctgaggtcaggagttccagaccagcctggccaacataatgaaaccccatctctactaagaatacaaaaattagctgggcgtggtggcacacgcctgtaatcccagctactcgggaggctgaggcaggagaattgcttgaacccaggaggcagaggttgcagtgagccgagatcgcgccattgcactccagtctgggcaacaagggtgaaatgccgtctcaggaaaaaaaaaaacagtttctgtgactgctagacaaatgttgagcaagtaaaacaccaacaatgttgaacttagatattgaaatagctgctctgtacaaataaagtctactgggagtatagactgaattaccatcttttgactctttcgccataatgattggcattaccggaagggattaccttgctttgaagagctgctggacagtagagcagagagcatctattaccattgtaggtgcctttcagttaggattttggatttataagcaaactccaagaaagagcctggttctgagtttctctgaatagcttaggtcaagtcctaaattctgaagccaactcctataattccttctttatgtctttggcatgtgaagtaggcaaatttcgaactttataataatagcctagacttacaaatacttgccttggtaatcaggatgagtttttgagagacaacatagtctagtgttaatcgcgtggacaccagactgcttgagtgaaatacaggttctaccatttattaacggagtaatgttgggtaagctatttagccagggtccttatctgtaacatggtgataataataaagattaaataataggtgaaaaatgtttagaataccactgtgttattagtaagcaccatgcataggtgtttggatttaaaaatactggcaaaggccaggttgggtggctcacacctataatcctcgcactttgggaggccaaggcagaaggatcgctttagcccaggagttcaggaccagtcgaggcaacatagattccgtctctgcaaaaaatttaacagaattagttgggcatggtagcgtgtgcctgtagctacttgggaggctgaggtagggagggggaggattgcttgagcccacgatttcgaggctgcagtgagcttatgatcatgccactgtactccagcttgggtgacagagcaagactctgtctctaaaataaaatgaaaataaaactgcaggcaaaaatgccaactgaagagtgaacatgaacttttctttgcatttttcttgggcctgagactttaagaagtgcagggcagttaaaatgatgagatataattctcacctatcagctcagcagaaattaataagattaaaaagatgcgtaatatataatattgcagagtgcatgggggaattgatatacacattcatgaactggcagagacaaaaatgggcacagaaccatttggaaagctattgtgtattttaaaaaatttcagtagcacattttttatatcatgaaatttcacttcagaatgtcagtcctgtagaaatactgacgcaagtgcaaaaacaacaaaaaccaacttgtaccttcaaggccagaaagagttatttcaccaaataacataattgaggtacattaactttattagaagtaaatctgataatctgctcacattttaaatagttatggtttaacttcagttcttgaagtcacatatttttacaattaggaatgctaacaggctttttgtgcaatacgaaaagatgactttaaatgcctacaattattttgtgtccttttatttttttttaatttttactgacctactacaaagcactaaatattttatgttcttaatctgaagaacaatagacattctctataaaacaactcttgcttattcatgaactttgtacacaagaagcttaataagacgggctcaaaattatttttctaaatatatttcctatacaaaataatttcaagatataattgttacttttgtgtctaatactgtatgttaaataataaaatggtaagcatgtaaaaactacaataccacaaagattgagctattttgccagtagtatactccaactttagttctagaacagttgtagaaatgggtaaacaaactgttttaactgtactcttaactgaaatatagtaccttatgcagtagcagaacatatcagcagaagaacttcacttgacctgtacttaaaaacaaaacagatgcaatttataaaatttagagaaatatagtgaccttatttgcatgtggaaaatgtacttctttctgatctacatatcttctgttgtgcaatgtaagcagtaaaacaaatagtacaggattcatctctgtgggacctagaccccctggtctaacaaataattcttggtcagtactgtaattctgtggtataaaactgataaaattagccttcctgtgactagacaagaagccgggcagtttaaatgctgaaactcacaagaacttcagaagctttagctttaagctttaagcttacttagaaatgttataagacctccagtagtcacatatgaagaatatcatgaagatttttccattaaatctttattatagatcccttgattggtttctgtctagactcattgtgtgataaaggacataataatttttatcaccttcatctaatataggtttgtcaactctatattagttgttttcttgaaggctggttttcttccaaaattcagtcttattttcagtctacactagcttttaaatatactgtcctttagatgctttatctaacctcaaatttctaatggatttgtcttagacacttattgccactccttagatagtcattgctatctttgaagttctggacgatacgtgtattacagaggaactggagacattccatcaccatagttagcttgattggataccctttaaaagcatatactcgcgcctgtaatcccagcactttgggaggccgaggcgggtggatcacttgaggtctggagtttgagacaagcctggccaacatggtgaaacctgtctgtactaaaaatacaaaaattagcctggcatggtaccacatgcctgtaatcccagctactcaggaggctgaggcaggagaattgcttgaacctgggaagtggaggttgcagtgaaccaagatcttgccattgcactccagcctgggtgacaagagcagaactccattaaaaaaaaaaaaaagcatatatagcacatattataaggttttcaattttttcaccaagtgtttcatttgggtagtcatttattggtagtttacatcagttgagtggttcagaaaaaatacagtaagttgcttataaaattctgaacactttggccaggcacaatggctcaagcctgtaatttgagccctttgtgaggctgaggcaggagaattgcttgagcttaggcgttcaagaccagcctaggtaacaaagaacgcctggaatgattgtggcatttgaactaatattcaggtttaacaagagataattgaccatcactctattttagaggctttatttgaaccagatagaaatctatttcccacagctatcactgcctgtcacctacaacttaagggggttggggaggaagtgagagattttctgttagggccaatagggacctgctagatacccccccatcctgggaatggtgtatggaactccagtgtatgctggagttattatcatcatacttgtttttttattttactcttctgcttatacagatcaagtcttacgttttatttttaagtttaaattgaaaacatttacagagaacaatgcagtgaaatgaaaaaattacagactgctggcatttgcattttcatgtagcctcagtgactaatttttttttattgtacagcattgagaaaatcctagttcatataactagttatagttcatatagattcatataactagttttaagtgataatagtttcttcctttttttcctccaccatctaaccagatgaagataatagtttttaatagctcaccgtaaatttcaaggtactcaagttaaattgatctagatgcttgagttgaaatttttctatcaaagttcaataacatgcttacattccttattaaagtataaaagtcctataaacacacaaacttgagtaagtactaaaactagtatcagtattgtcacaatacaacatgttatattgtaacaagagcatttgctgagaactgtgcttgttactccagaatgttgcttctatggttgtacctttcaactttgcagatcatttggaaggaggagagatttggggtggagacaattcggtacttcattcacaggatgtaaggaggattaagtaaaataatgctggctaaaagtccttatttagcatactgcccaatgctcactaaatcataatagctgtttttaacatttggtgaagaatctatttaacaggagtgagttgaggggcataggagatcatgtgagtgtttaaagtagaagcagcattccccattaagaagagaaatactgtggaagagcaaagactttaaaacacctgggttcaaatcctatttgctacataatggctacttttaacctattgaacgccagttccctcatttgtaaaatagggacaatatttaacctatttacaggttgtgagagaactaggcacctagtacagggtaatgttggcacatggtaacctttaataaactgttgctattcaacaagctattagatgtcactaggcagttaagcaaaggaagacagcttttgcttggtgtgacaatgaaaatctttctgatttccttcttggaagagttccctgaagatatgtcattgtattgacacctttatttttgctaacctatccctctaaattctggatattgtgtgtgccacagctttttttcttccatattcctgcatttatttggcacctgttgtgccagtaatagataaggggctgctaagggaggaggcaacctgcactggcttatagctgctaatgtcagttcctatagcttatcgtcagtgttattcatgtggtaaaagggtgagaaagtactggagtctaaagaaacaagtagaaatcagtttgtagctattaccgttctacctgctaacaactcctgttttcaagttattatgtacaactttaggtagtttctctagccttaatcgtggtttctctgtattgagactacttttgaattctatgaagtacagccttagatgtacaggctactttaaatttttgcctaaaataaaaacattctctccaattacatatgctggggaggaaacacctgcttccgacaggtttaaagcttggttttggactttttgtgagagttccttatgtgtgcagtaatccaaaatttgtatagttgccctttataaaagtacattaatctagtagacaaatctccatgtaacttaattacatggcatcttctaatccttctgtgataagcagaaatgtaaagttttattcaagttaaggcaaactaacttgtatacactttccatctcgtgtttttcttgttgttgttaagtaggataagttctgaacgtcgaaaagaaaagtctcgagatgcagccagatctcggcgaagtaaagaatctgaagttttttatgagcttgctcatcagttgccacttccacataatgtgagttcgcatcttgataaggcctctgtgatgaggcttaccatcagctatttgcgtgtgaggaaacttctggatgctggtgagttattttacaagggtataaataggcctgaaaattagaagttagaagtaaatagaaattatttttagaaggtggtcgcaatgttttgattttgtatacctctttatattgtgatatgtacacgtttaaaaatttttctgtaattctcactatttttatcaagcttcatttttttctcatcagttattctttgaaataatcattctttatgcacataatttgttttgctttattctcttaaacatactctcaattcttttctaatataacatcctttttattacctgcttttaaagctttagtcaggaataagatactggcttttcccctcccccctttttctcctgttccatctacctttcttcctttaaaaaacatgactcaggccgggcgcggtggctcacgcctgtaatcccagaactttgggatgctgaggcgggtggatcatgaggtcaggagttcaagaccagcctggccaagatggtgaaaccccatatataccaaaaatataaaaaattagatgggcacgctggtaggtgcctgtaatctcagctactagggaggctgaggcaggagaattgcttaaactcagagggcggagcttgcagtaagccgagatcaagccactgcactccagcctgggcggcagagtgagactccatctcaaaaataataaaataaataaataaataaaaaacattactcttctttcttcttctatggtttgctttgctgcattactttaatcatgaaaagcagctggcacatctaattatagtttttctagcttctggcctgcacttttctgtgttgaaatggctgtatatattaaataaagtgtctgcgagaaaactttgtaaaaacatctaaatattatatcatttaagtacaactttttaactaattattttcctcttcttgtgccctttttaggtgatttggatattgaagatgacatgaaagcacagatgaattgcttttatttgaaagccttggatggttttgttatggttctcacagatgatggtgacatgatttacatttctgataatgtgaacaaatacatgggattaactcaggtaaaatgcacacatattaagagctcttctatatgtttttatgattttatgatctagccctaatttttaaaaatgtgtttacagtttgaactaactggacacagtgtgtttgattttactcatccatgtgaccatgaggaaatgagagaaatgcttacacacagaaatggtaagaaaagtctgttgtttgatttaatgtgacaggtggttttacataataagatactattgctaattattaaactttgctattgtacttacccaaggcaaaatgttatttcatgtttaataaaatgtctattctttgttaaaactattattttagtttttaggaatttcattttgaaagcccacctaattgcataaataattgtgtgggtgtgagaaataaaatggaaaagtaaaatcatgaccaagagagttacaaataactttttttttttttttttaagatggggtctcgctcttttgcccatgctggagtgcagtggcacaatcagctgactgcagccttgaccgctgggactcaagcgatcctcccacctcagtctcccaagttagctgggaccacagacgcgtgctaccatgcccagctaaatttttaaaaattatttgtagagacaaagtctcactatgctgctcaggctggtcttgaactactgggcttaagccatcctctcacctcggcctctcaaagtgttgggattacaggcatgagccaccacgcccaggctaccttttttttccttttctttttaaattgtgataggggttcttgctgtattgcccaggctggtcttaaactcctggactcaagtgatcctcctggctcagcctcccaaagtgctaggattataggcatgcgccaccacacctggtggagttaaaaattaaaatacaccattaaggcaaggagaaattataatacaaatggcagataataggactttagacagtcattaaagttgaggtgccagtttgagtctaaggcccaataaaaaaagttcaccagaattttaagacaaacaactgcttatttgacttctttggatgttctcaataattcgagaccgtgtagttagattataaagtattacattgtggatgcccacatattaacaaaaatagagagtaagacctctaattcttaggaattaattgttaaaaataatcaagtgttccaagattttttggaaactacctcttgaattaaaaaattaaagtctttctacatttttatcttgttaaacagtgtatactgatcataattatttaaaaaatcatgtgttctaagatttttggaaagtacctcttgaattacaaaaacaagaaagtctttccacatttgtgccttcttaagcagtgtatactgatcataattgaacttttcttcatgatggaaagttaccacaaggaaaatttcttatgttctgctgttctttgttgctctccaatttaagtgcatacgtttgtttgcttctatattataaaacctcaaatttactttttgtataatttttgaggttttctttttcatctcatttattataataatagctaacctccattgagagaatgctgtgtgccaggacactgttcttcctattttatatgcttttaactcctttattcctcacaacaaccctgtgaagttaactgttagacaatttctattttactaggaaactgaggtacagagttactaagtaactttcccaacattatttggttagtaaatggcagagcttgggctgaacttcagtagactggcttcagagtccacgctcattagtcctttggagcgcttttcatattcttgaattctcacattctgtcttttttcactctgtcagcaggacctgactcctgtttttaaatttcatattgtgtttttactgttaatttggaaaacaaatgcatactttttagaattctgtataaaggaggagtaaatatgctgtgaacaaggacctaagtgggttgtcaatgagtttaatatatgagttctaatgtgcagagttgaggtttatattgactgctcagtgcttccctggggctagactataaatggatggatattaggaagtcttgttctgatttggtaatgatgttaatgcattattctaaatcagatagtcttaatatagtttaaatgtatgtttcgaaccaaatgttcttttttaaagcacacaaacattttgaaatcattactaatgtggttaatgaattattgatgttccattgggaaactaaaatgcagatttttctcttttagaaatcagggactattgcaaagcatcacattttagtgatacactgagagccagtggtgtgtttatacaaatagtcctattttccaaataaattctagaaaaatgctttagaatttataaattatacaaaatatgacttatttttagagagtttaaaatttaggtttttttaatggtttgtttttgtttgtttgttttttgttttttttttcctcattaggaaaacactagtacttttcagttaccttgatttttaaattaatctgcaggtccccattcaaaggccttgggttcctttcaaaggtcagtataattcaagcttagtttatgaaggactgaacatacccaaaggattttgcatgtggatctttactgccactaccacaaccatcaacacctacacacacacgacacacacacattctctctctctctctctctctctctctctctccccctccctcccgcactccttcccttccccctcctttgctctcatggcatcttttaaaaatatactcttaaatccttccagggagggcaaattcacttcttaatctaagtaaacccaaatggcatgcatcagcaccaggactgcccatctttcctagttccattattcatagagtataggctggaattcatcttgttcctcaagagtccagcatttctagttaaccatgcctacatttaaacttactctcatttcttttctactttacagtgttttttcaatatactagcattacagtttccagatttgatttctctcctgtcttatttccatcagttttcaagtctattaagattctacctcttcatttgtcttttgccaccattcttttccctcatactctactggctcagccctctcattacagtcacctaattctaacatatatattgctgctaagttaattttccttaagttactgattgtgcttttttaaagccccttgttgaatatttaggcaggactccatgtggacatccacagccctccgtggtacagccctaaccttcccttctagctttgccttactactcttctacgtgtactctacattgtggacaaactactatatgctgtttttcaaacatgtcctatttttcctacctctgtgcttttcattctcttacttctccttggaatacccttctaacccatctctacttactgacattctaatgtctctttttctaagcaagacttcttgatttcccttgactagaaattatcttctaagctctccctatccttctttaaagcatttttataagtctcaagtaccaactctacattgtgtttttgttgaccttactatatctactacatttttaacttcttcaggaaaggtggcgtatcttactcatctttgtattgcctacaatatctagtccaggttctgaataataaatatttttatatgtgttctgaagcacactgaccaatgaagataagaaatcaagaggctagttccttattttttttaatttttttttttgagacagtgtctcactttgtcacccaggctggagtgcagtggcacaatctcagttcactacaacctctgcctcccgggttcaagtgattctcacgcctcaacctcccaagtagctgggattataggcatgtgccaccacacctagctgatatttatatttttagtagagatggggttttgccatgatggccagcatggtctcaaacttctgtcctcaagtgatcttcctgcctcagcctcccaaagtgctgggattacaggcatgaggcataagccactgcgcccagcaagatgctcttttctcagtcacctaaatataatctcatttttagttatagaaggtttgaaattggagtgaatagactttacttaattctgactttatttctgtagctttttttttttgagatggattctcgctctatatcccaggttggagtgcagtggcacagtctcagctcactgcaacctctgcctcccacgttcgagtgattcccctgcctcagtctcccaagtagctgggattacaggcacccactatcacacccagctaatttttgtatttttagtagagacagggtttcaccatgttggccaggccggtttcgaactcctgacctcaagtgatcctcttgcctcagcctcccaaagtgctgggattacaggcatgagccaccgtgccctgcctatttctgtaacttttgataagtcatttgatctgttgttgttgttttctcatagtaacaaagtagaagtaattttctgcctgctttactagataaattaaggggaaaaaaataagatacgtaaaaatgttatttgttattaaaaagaaagttgttattttaaaggttctataaagacatagagtgcttattagaaattgagctaacacattcaggaaaggataggaagagtttgctgaagttctttctttagggattcttgtgtaccgatagcacagttaaagagcaaactcataccatttttatatttctgtgtatttgactaagcttactggcttcaatgattaactgttatcccaaatatggattatctttcagccaactcagggaatcacagctactgagtagtgtgtgtcagatctcttgggtgtgctggagtgagtaaaaggggaatgaattactgtgttcatgctgagacttaattgaacgggtattcagttgatctaggtgatgggcactttgttacttttattgtaacaaatttgtatatttagttgctttaaaactttatttcatgctttcattaggccttgtgaaaaagggtaaagaacaaaacacacagcgaagcttttttctcagaatgaagtgtaccctaactagccgaggaagaactatgaacataaagtctgcaacatggaaggtaagtgaaaattatttgtgattgattatacactttatttatacatagacattgtagtattaagataactttagaattgtgagggaaggtttacagttccatggtgtttggttatgtaacatttatatcttcaactcatttgcatgtgatctccaaaatgcagaaccgtgtagtaatttgccaatttgaggcacaaacttaaattacgtgaattgtggcactggtgttccaggcttaatcagttggctttgccagccacacaatatttgaatcctgatagggcttaattttctattaatcatggttttatatctttgttcaatgttgaaacatagtcatcagtgcaagaaataactatcaaacagccatgatgatgagatgaatgaaaaagcagcctagactttatacgaggggaattttttaaagagtaatgtataggccctgggcaggaagtaggtcataggtggtatcataggaaaaatgttcattgattttcaaaaacgtgattaatccactagtgacagtaaattttatcaaagcttactggccatgtcagactcaactacttatctctgctttttttttccctagcattgtaaatattttttttaactgctttgttcttcatacacaggtattgcactgcacaggccacattcacgtatatgataccaacagtaaccaacctcagtgtgggtataagaaaccacctatgacctgcttggtgctgatttgtgaacccattcctcacccatcaaatattgaaattcctttagatagcaagactttcctcagtcgacacagcctggatatgaaattttcttattgtgatgaaaggtaaattagatctaaaatgtgaatttgaaatttttaattagtctacagcattactgaatattcaccatagcaaagattcagcgctggccatgcatggtggctcacacctgtaatcccagcactttggaaggctgaggcaagcggggggtggatcatctgaggtcaggagattgagaccagcctggccaatgtggtgaaaccccatctctactaaaaaatacaaaaattagtgggacgtggtggcaggcactactcaggaggctgaggcaggagaatcgcttgaacctgggaggtggatgttgtggtgagctgagctcacaccaccacactgcaagcctggatgacagagcaagactcccatttcaaaaaaaaaaaaaaaaattactcaatgttaaactatactttccactaaattgaacagaatgatacatcctataatattagattaactttgtaaattaattcagccacatttattgaacatttactctgtactatgaacacttactttactaggtgctatccagaagttaagatgagtctttttttccccaataggggctctacttacttagagaatttcaaagatatgcagtgtgtattttgagcaaagatagattaccttaggttggggactagaaagccaagtgtttgtacatctcttcatcctacatattttccctgagaagcttcaaccttgcccatggtttctattactatttcccacatttcttcctgtaactaattctatttaattgccaacttaatatttctatctggatattcttctgtattgtaaactaagtattactgtaacaactgtactactactgcccccaaacaacatcatcatcaaaaactgcctttcttcctataatgcttattgtggtttaatacaccaccatacacacatgactccagcaaaactttggaagtcatctgtaacttttcttttacattcattggctacatacagttggtgtctaaatcttacagatttactatctacatatatctcttgatccatttcctcctttccatccttgcactcctgccattgaattcattagctcattattactcttgacttgagttgttggcatagctgcctttttgccaacagatttgtacccttataatctttcatctaagttgccagaaagtgggtgtcctaatgtgaaaatcagatcatgtcattctgttgttgaaaatgcctcaaatgcttccctccatctttgcacacaaaaatattttgtttataaaaatactagatgagggaagtaaatttttcatttatcaaaagaagatgtgtattttagaagactgaaaaaaaatagacctacacaatacaatctaaacttagcatggcaaacaaagatatttatgctctggccctaactctgtctttggaatcagatgttagattcactcatggcttgcagctctgatacttacaatgtggccttggccttggtacttaactgttgtaaaattcacattccttatctataaaataagaatcatggctgggtggggtggctcatgcctataatcctagcactgtgggaggccgaggtgggtggatcacctgaggtcaggagtttgaaaccagcctggccaacatggtaaaaccccatctctactaaaaatacaaaaattagctgggtatgggggcacatgtccgtaatcccagctacttgggaggctgaggtaggagaattgcttgaatccaggaggcggaggttgcagtgaaccaagcttgcaccactgcactccggcctgggagacggagtgagactccatctcaaaaaacaaaaacaaaacaaaaaaaagacctcagaaggatgttgtcaggattaaaggagtccattgagtgcctagtacagatagtgaatgcttcactactggtgtcaactttaagaaaatgaatatagaaaagctaagaattattttaaggtgtttactactagcatgtaaatgtatgatgggacagagatttccatcctattttgaggaattattttttatttttttgaaaacttaaggtaacaaagtagagaggaggccagggagaaaggaaggtagtggagcaaaaatgagaaagggagtgacattcccctctagttatagcagaaaattagcaaaatgatcatgacaggaggtaacagtaaagacagccagctcatatatcaaccaagacagttttgagtttgaccagcagactgttattttctggtttagagctctttccaggaacttcttgcatctataacccctgagaaccaagctatggaaaaaattttgctcaattttaagaaaatctaacatatcaagctcctcaactccaaaatattccacaaatagctgctatttactatactgagtaataatcatttaaaattattcaacactttatttgagcatctactatgttcatggcactaaagtagaaatgaagatgaacagttcctgcctcaaaataaatgagtagtatactgctttagatcatgggtttcctagtccattaaaaacactttttggtcatattttctggacaccccgacccttttggtatagaatataacctatgtaattctctaaagttaaattaacctcacttttcttgctctaatatgtgtaaaactgaccttctaggaaagcatatacagtttatatttttgacttcttggtatcttttagtgatagacatacctcagattgagaagcactgattgacattagattaaatcagagcttcctatgacaatataaacaataccttcattaatctgatccccctacctacttcttcagcatcatctcatatctgtctccactaatcatattatagaatctttgttacctgcaccatgttaagcatttttaaaaatcttttgtttataccatacctttttcctgaaagcggttttgcctttcctttgtctctagtcataagtctcctataagaggctgttcctcattctaccattcctttgcatggataggattccatggaatagattctcatcactgcatttatcacattatttcctaagtagtacagtacatctactggaagattagccacgtattgagttttgtctttgcattttcatgcctagaataatgccgggcacacataggcatattaagatttgaatagtgaaaaagtttttaattccatggggattttatttaaacagaaaaatataagaccaattagaattatttttaaagcataatttcaagaaatatgactgattttgtttaaaaacatgttttcctttataatgctgccacctggtgttgctgtgtttagagatgtccctttgtaaagaattgagggtttgagttgagtttggtttggtttttggcaaatcagcttttcctttgtatatttattttgtaataaactatggaagatcttgcctttaagtgtgagaacacaagcaatgttacttttatacctttatagaatatcttgcctatgtccttcctgtagttaggtagggttttttttttgacacacagcatgttatataaggtttgcttgcacctcggtaggaaagtcctctgaaatctaaaggctgagaatctaaaagcttaactcatgttttgctcctagaaagacttgagaagagagtatttctgttcagcatggtactaagaagacagctttctcttcctcatgtcatggttgccatttcatactgcttacagagaataagatctagtctctgtcttaaataaaggtctactctctgccagcgagctagatagggtaattggattgttttccaatctattttcatttgaaatattgttttatctgaaattactcccataatttcatgtaatgccaaaaactaaactaagtacaagagcatcttcaaaaaccaacataattcctttagttcccatttagtgtagatgctctttggttgatgatattagaattgtgtaatggctattgatctctcaaagtgaggtgttgcctaggggcttaaaagttactacataaagaatttggctttatgaagaaatgttacagattttatctatattttaaaataagtgtaagtgactacctttataacttttaccatgtagtttagtagtatttcttatctgtttattaataccctgccttgttaccaaaagtatgtataatgagatgtaataagaataggtaacaagtaggctgggcacgttggctcatgcctgtaatcccagtactttgggaggccaaggcgggtgaattacctgagttcaggagttcaagacgagcctgaccaacatggagaaaccccatccctactaaaaatacaaaattagctgggcatggtggcacatgcctgtaatcccagctacttgggaggctgaggcaggggaatcgcttgaacctaggaggtggaggttgcggtgagccaagatcacacctcattgtgctctccagcctgagcaacacgagggaaactcttgtctcaaaaaaaaagaccaggtaacaagtttgggtgaacaggattaaagagttaaataacaggaggaatctagaggacttaaagaaatgtgtggtgttggatttaataactgtagttgccaaaggtgaggtgtaaatttattctaagcaaaggaggatgctcatttttgaaaattcacttgtccataagattaatgcctatcagttaacttgggaggagaaaaatttttctttatcagtgtctcccttttttttcttaaatcttgtattttttactaacagaattaccgaattgatgggatatgagccagaagaacttttaggccgctcaatttatgaatattatcatgctttggactctgatcatctgaccaaaactcatcatgatagtaagtacaatggaagaactcagagatattctaattacttaactgttgcaacctctgtacagtttggctacccatctaattctctggttaaaagttctagactaaatgtgttaacaggcctattcagtagagatcttgaccattttgtgttttgtatgtgttgcaacaaatatcagtaaaaatagaatcatttaatcatagaaaaaacttcctggcattttaaatacaaagacttttgaaaatccaaatattatagagtattgaatagcataattttcagaattcacataaatactcagaacagtggttggtatgtaaaaggcactcagaaagtatttgtacaatcaatgaatgtgaaggtggtgaacatcacctttggtaataagtaccattttaaaaaatgcttataagtgcatagttaggtatttatatttatgggttcatgaaatattttgatataggcatgcagtgcataaggataaatggagtacctatcacctcaagcattatcttgtgtgacaaacaatccagttatactcttttggttatttttattttattttattttatttttttcttttgagacaggatctcactctcgcccaggctggagtgcagtggagcaatctcagctcactgcaacccccgcctaccgggttcaagagattctcctgcctcatcctcccaagtagctgggattataagcatgtaccaccatgcctggctaatttttgtatttttagtatagacagggttttgccatgttggccaggctggtctcgaactcctgacctcaggttatccacctgccttggcacccggcctcttttagtttctttaaaatgtacaattaaattattttttactatagtcacccaaaacaagtacctttgacataagatttgattctgaattttactcaaatgaatgttaagatccccaagataagttaaactttggactatctcacctgtttaatctgtacctatgcatgacttcccactgtgcttgaggatacctgaatatcactgagtttgtgtgactgatcagccttgaactcaagagtaaatccaagtctgcagtcaggacaccccaatcctcaaaataataccatcattagcatttatttagtactttctcccaaatcagtatttaatttaaattgccaaaagacttacaatgtggtatcaatttatatttaaatatgctacatatagctttttaaagcatctttggttctctggaaaccatagtcagaatttaaggaagttattgtggcaccattttcttgaaaaaggctattgattattctctaatctgacaccaacctaagtcattaaaggaattttagttactgaagattgtatattcatgaactcttcacttagctcactggcagcaaaggagttttatttagggggtttgaaaaaggaaatgggtacattttcagctattctgggacgcactgtcagaatgtaagcagttacaactgattccactaaataaacatttgttttccaaaacaatgatgaacattcagcatctgttcatttaattgaaaattcaaagttaaaatattttctctgcatgattctttttcttttcccccctagtgtttactaaaggacaagtcaccacaggacagtacaggatgcttgccaaaagaggtggatatgtctgggttgaaactcaagcaactgtcatatataacaccaagaattctcaaccacagtgcattgtatgtgtgaattacgttgtgaggtaagtaagtttgagaaataaacatttttggggaacaaatagtaattctttttggatactctgttcatttataggaagataagataataaatattaactaaattttaattcttttacatcgctaccaaattattattttctatactctgacctaggtttccagtccagctattccacagtgatgctgctaaacactgtcagtagttgtctatccccataccttcactcctatttttaaaaagaccatgaaaaaaataccagatccattgattggtttggtctaattatacagatatcggcatatactatctcaagacagctgtgttctttttgtaggaagaatcctggcctagatttgtatcatagctctaccactcattagctccctgaccttggggaagtctcttcatttttctgaatttcatctatgtagataatccttcagaaggttataatgaaaattaaatgaaattctatgagattagggaggggggagggatagcattaggagatatacttaatgtgaatgatgagttaatggatgtagcacaccaacatggcacatgtatacatatgtaacaaacctgcacgttgtgcacatgcaccctagaacttaaagtataatttaaaaaagaaaagaaattctatgagattaataagctatatgatgtaatacatggctcttgtatattcatgaactcttcacttagctctttggcttgtgaatattatgtacatcaaaatttaatttttcatttgatctattttactagactcctgccccatctagtctacctgtccacattattaccacattctagtccatcttgcccattactaccaggctaagctttctagtgtggatatgtcatcatcttattttccttagaattttagcgatctttttatcatttccaagataaacacttgcctaggtgtacagcatccttgtttaccatcatactcacgcattagagatttagccttccctttaaaatctagggtcactcctcttaggaagactttgggcagtttttatttttgctacttctgacaccatcctttaatgttttaatattagtgccacagagttcttttgtgactttaccattatgtaagaatcttccacttggaatgtctttctcttcctcacaccccagtctgcctagcaaatgccacttgatcccaagtatcagcttgttagcttctcagtgaagcaagccttctctattttagcagttatcacagtgtattttaattgtttacatatctactttcacaatgggttataaatttcttaaggtcaagggttggctattttaatctttgcattatcagttcatttcagatagtgaacatttaatacgttaattaaaggaataatttacatttaagccaaacgtgaagataaactattgctcatcatccctcttcagccgtatcctgtaggtggtatcaccttatattcttaccaccaaagaaaatatggcccctctcttagaaagatcttaatcatttatctgtgtatctttaggactatccttagatcatgcctcacatattgatgccaaagagttcttttgtgccaatttcataatgtgtgtcagcacaacaattctgaagatttgttggtgtctttcatgtacttgactacaaattgccttgccattactactcttctcaaaggatatctgaaattctttttttcttttttttttttgagatggagtctcactgtcacccaggctggagtgcagtggcgtgatcttggctcactccatttcccgagctcaagtgattctcatgcctcagcctcccaagtagctgggactacaggtgtgcaccaccacaccgggctaattttttgtatttttagtagagacagggttttgccatgttggccaggctcttgaactcccaggctcaagcgatccacccgcctcagcctcccaaagtcctgggattacaggcatgagccaccacgcccagcctggatatctgaaattcttaactgaaattagtcaaattatcttgtactggggattttttttttaatttcaacttttatttttgattcaggggatacatgcataggtttgttacatgggtatatcatgtgatgctgaggtttggggtacaattgatcctgtcacccaggtagtgagcataatacccaacagttgttcaacccttgcccctctcccctagtagtcctcagtgtctattgatgccatctttatgtccacaagtaacccagtgtttagctcccacttacaagtgagaacatgcagcatttggttttctgttcctgggttatctcacttaggataatggtctctggatgcatccatgttgctgcaaaggacattatttcattcttttttatggttgcatactgtggattttattgggtctttattttgtattagcattttaaaaccctaaatgtgacacagtacgcatgagtgatcatgcatctcaagaaatcttgaaatgttcctgtccataaagcagaattttttaagagaccatttcacagtctcccttcccctcactgtatcaagtgctcatttgtgaattaccaatttctcttgttttgacagtggtattattcagcacgacttgattttctcccttcaacaaacagaatgtgtccttaaaccggttgaatcttcagatatgaaaatgactcagctattcaccaaagttgaatcagaagatacaagtagcctctttgacaaacttaagaaggaacctgatgctttaactttgctggccccagccgctggagacacaatcatatctttagattttggcagcaacggtgagtagttatttttgttaatcccctaaattgtgtctgttgctacaagccccatttcaactaaacattactttacggtttttgttggtaatcatttggacattacaagctaatatatgtttatagttttcttaaatgtatttgcttaaatatttttgcccccgtaatttcttaccattcttgcttttttatactgttggaaattgtgcttcaaagtgtccttaaggtatttcttcttcccacataaatttttcctggctactctatttctgtatcctgctgtcagattttctccacagtttagcagagttatatggaagtaggcattgttgcattaaaggataaaaaagtagtcatactataacatcaagcattgaagatgaaaactgcaattttaaagtagagaacattttaatgtataaaaaggttggtattgccttttgtcttttatgccatagagattaagacgcggtatcaatagtggattgtaaaggtaactcagacttatggttatactatactattgtatgtaaactttctgatgaaggaaaatttggtgacattttgttgtttgatgaattagacaaaccttttgtgaaaaagaacataaattttttatatgtgaaaatccttgtggccgggcgcagtggctcacgcctgtaatcccagcactttgggaggccgaggcgggtggatcacttgaggttaggagttcgagaccagcctggccaccatggtgaaaccccgtctctaccaaaaatacaaaagttagctgggcgtggtggtgtgcgcctgtaatcccagctacttgggaggctgaggcaggggaattgcttgaacctgggaggcagaggttgcagtgagccaagattgcgccattgcactccagcctgggcaacagagcaagactctgtcttgggtaaaaaaaaaaaaaaatccttctatactttagattgactcatattttttccccacagacacagaaactgatgaccagcaacttgaggaagtaccattatataatgatgtaatgctcccctcacccaacgaaaaattacagaatataaatttggcaatgtctccattacccaccgctgaaacgccaaagccacttcgaagtagtgctgaccctgcactcaatcaagaagttgcattaaaattagaaccaaatccagagtcactggaactttcttttaccatgccccagattcaggatcagacacctagtccttccgatggaagcactagacaaagttcacctgaggtaggtgtcatgatataatcagaaagggacaactttcagattttaacattcaagaatgtatttataagtttgattcaaacacttatttgaaccacaaattacatttgtgtgtgtgtttgaattttagcactttaaaattattgcaagagctactgcctaacctagacctgagcacatgttttaggctcaaagatagtcaggaacatgggaagaaactagcttaatataaaccaaaaggtgaaacgtacattgtttctctattatttatatcagtaggacaaaaacatcttgaatttggacatttaaagagaatagtactaagtgtgctcaaggtagctacagcctatacctgttaccccttttagtttgttttattgtgttttgttttgttttgagaaagagtctcactatcacccaggctggagtgcagtggtgcaatcacagcctcaacctcccaggctcaaatgattctcccacctcagcctcccaagtagctgggactacaggcctgcatcaccatgcctggctaattttttaacctttttttgtgtgtgtgtgtggagttggggttctcactatgttgctcaggctggttttaaactcctgggctcaagcgatcctcctgccttggcctcccaaagtactaggattacaggcgtgagctaccatgcctggcccattacccctttgagttggagaactgtctggtagcaatagacttacgagggtttaaatgggaaaggaccttataaattctttgcccaatttagtctaatttccatcactattttgaaattttgggtaagtataatatgaaaataacaagtgttacataaaataaatacttagtaactggtcttttttattctggatctgtcttgatattaattgtcctatgaacacaaaaataatctttaaaggctaggctggccaagacttagagatatcacacagggctctatttctaaatctagaatgattccattttagggcttcctacatctaaaaatatgctcaggagtagggcaacttagatctgaacattataacttgataaatgaggcataaataagctttaataagtggtaaataattctacattaggtatttgttgaataaaactgacaagctaagagtaggggatttgacatctcacagccttgtgttgaatgaatatatatcctatgctctggttgcttaatttacccagaaaaaaaaatgtttgattcatcttggtttttatctaacaaaagtaaatctaacaaaaacgttagaatgaggaaagcaaaatttcttgtttagaatacacagctatagttttttgttaaacttcttgcccagaactcttaaaatagtaataatgtacattcgttcaggtatatgcaggtaaaataacttaggtttctactcccacccccgacagtaacagtgagatttttaggtagctcagtcaccacaggagtgtgccttctcagttcaaaggtaaattccagtgaatgtagcatctagttaattggtcaattaggtaccattgtgggatgtgaattaccaaataggttttattctttagaataaggtgtttcttttcatctcaattttgtaaatgatgttatattacatagtcagaaatatatatattggcaaaattagttaccagtataagcttcaaaatgtcactattttcacaaatttttttttttttttttttttttgacatggagtctcactctgtcgccaggctggagtgcagtggcatgatcttggctcactgcaacctctgcctcccaggttcaagtgattctcctgcctcagcctcctgagtagctgggattacaggcgtttgccaccatgcctagctaatttttgtatttttagtagagacgaggtttcaccatgttggccaggatggtctcgatctcttgacctcattatccctccaccttggcttcccaaagtgctgggattacaggcgtgagccactgagcccggcctagttaaataaaatttgataaacacgatggacttggttgtgtgttttctggtttttctgagatctagtttgaaaattctgacaactagcaaagtatatggaagcttcttcaggaaatagtaaacatatttctttttacagcctaatagtcccagtgaatattgtttttatgtggatagtgatatggtcaatgaattcaagttggaattggtagaaaaactttttgctgaagacacagaagcaaagaacccattttctactcaggtatatgaacttatttgttttatattaaatttcattaatttttagtctgaagtgactttgagtttcacttgttttttatttataaggtgtggccattgtaaaaactcatgtatttgctgttttaaaggacacagatttagacttggagatgttagctccctatatcccaatggatgatgacttccagttacgttccttcgatcagttgtcaccattagaaagcagttccgcaagccctgaaagcgcaagtcctcaaagcacagttacagtattccagcagactcaaatacaagaacctactgctaatgccaccactaccactgccaccactgatgaattaaaaacagtgacaaaagaccgtatggaagacattaaaatattgattgcatctccatctcctacccacatacataaagaaactactagtgccacatcatcaccatatagagatactcaaagtcggacagcctcaccaaacagagcaggaaaaggagtcatagaacagacagaaaaatctcatccaagaagccctaacgtgttatctgtcgctttgagtcaaaggtatttatatgtaacattcaagttatagttcttttattatttttgagataaatgtatgtgatagtacatgatttttaaacttatagcaaactttctgatatatatgccctaacgcaaattcttgagaactcaaaaaactttctaaattaacctcatatattttttctttttctttcttttttttttttttgagacagagtctcgctttgtcgcccaggctggagtgcaatggcatggcaccatctcagctcacggcaacctctgcctcctgggtgcaagagattctcctgcctcagcctcccgagtagctgggattacaggcatgcaccaccacgcccggctgatttttttggtatttttcatagagacagggtttctccacgttggtcaggctggtctcaaactcccgacttcaggtgatccgcctgcctcagcctccgaaagagctgggattacaggtgtgagccaccatgcccgctcctattttttctaaaataattataaattctaaaattacctatctaaatggaggagggtcttctgacacctttaaaataaaatccagctcagtactgtaaatgtgtttacagaacttgtttaaagttcttacagttgtttaaatcagactagttaactaccctcactacttagatgcttccatttcttagagctcttttttaagcttatctgaagaaaagcccttccaatttaagggttatttccaattgcacattccaaattgagccttccatcttcagcattcaatatagatatttacaggcccctcttttaaaattttattatagttaacttgtattaaagttgcttttatttttcattacgtatttgtagaacattagctatatatatattgcaggctacataggttttcaaactgtacaacaggaatctaagcatgaattgttacttctatggagctagttcaaacaaacatatggacatgacccaatttttaagttatactttctgtatataatttgtaaggggatttcacatattttaagtttgaggctatagctagaagaaattaagttttatctaataagtgtgtggaaaagggaaatgattccttctctactatgtctagactaagccagatatcaatagcaataggaaagaaccactgtcgtagccagaacacatagcttttttccctgcctaacattcccaccttgacctagagtgctgggagaggtcttttccctaagcttggaaaagacattggggctttagatgaactcagaagtactttacattactttatttactgtgtcacttactcacttttgactctgagctccacgagggcaatcacagtgtcttgggcattttagtgatactaatacttagctcatgacctaatgtgtagtacttcctcaataaatggttgttgaggcagggcgcagtggctcatcactgtaatctcagcactttgggaggctgaagcgggtggatcacctgaggccaagagtttcagaccagcctggccaacatggtgaaacccggtctactaaaaatgcaaaaattagctgggcgtggtggcacgtgcctgtaatcccagctactttgggaggttgaggcaggagaattgcttgaaccctggaggtggaggctgcagtgagccgagatcgtgccattgcactccagcctgggcgagaagagtgaaactcggtttcaaaaaaaaaaaaaaaaaaaaaagttgttggactgacagatgcatgaatacagtagtaaaaatgacaatcacttataagttacagtttactatcagctacagaggatgggatatccagttttctgaacaactgttctcttgtacttgtcaaagccaaagtgtaacaacacatcaagtcactttagcaatttatttttgagacggagttttgctcttgttgcccaggctggagtgcaatggcgtgatctcggatcttggctcaccgcaactgccgcctcgctggttcaagcaaatctcgtgcctcagcctcccgagtagctgggattacaggcatgcaccaccacacccagctaattttgtatttttagtagagacagtgtttctccaggttgatcaggctggtctcaaactcccgacctcaggtgatccacctgcctcagcctcccaaagtgctgggatgacagttgtgagccactgtgcccagctagcaactgtttttaaacattagttccaatgtagtgtacactgaaaacttttatgaaaggaatttcaaaaattaagataaaccattaaaaacgtaattactaagtactactactactacaatgatatttacataatagactgagttacatttcataaagacaatatatctgtataagaatttttaaacttccctgtctatataatagaagttttagagaaattttttaaaaaccaaagaaaactgcaaaataagatcacttacctatttggcattctcaactgtctggaacagcaaggagccattatgattatgcatttggtttgtggggtgtcttgaaaagtcaaaataatgtaacaaagctgatgtactttactcattagaacaattcttcacaatttaatattaattttagatatacatagttcatgtttgataaccagatcaatactgagtgaaaaatagcatagtgggaagagcaggggaggggaggtagggatctggagacctagagtgtacttccatattgcaactagtgagcagtaggactttgagaaagttacccaataggcctcagggttctaatttataaaatgggtatgatatgcctgccttatctgtcttgggaacttaagtaaggttaaaatgaactaatgaacttgaaatgttttataaactgaaaatgctatacgaatgtgagattgatcttgtatttcaatagtcccaacaatatcactgcattgttatattaggtggaataaaaggacaatatttaactgttttgactctacaatagtgtcaatttagttgtgttcagctctattttataaaatagggatacgcatactgtagaaaatttcctgttaaattaagctttgacggccaggtgctcacgcctgtaatcccagcactttgggaggccaaggtgggcagatcacttgcgctcaggagtttgagaccagcctgagcaacatagtgaaatcctgtctctacaaaaatatgtatatataaattagtcataatcccagctacttgagaggctgaggtgggaggatcacttgattccagaggcagggcttggttgcagtaagcagagatcacgtctctgcactccagcctggctgacagagtaagaccgtgtttcaccaaaaaaaaaaaaaaaaaattaagcttttacttttaagatgataaactttagtgatcaggaaagttatcttatgtatattatattccttaatattggagaactaaagaattatgtattttctttaaaagcgctcactggatattttttttaaaaacgctatattttcatttagaatttttttcttttcagaactacagttcctgaggaagaactaaatccaaagatactagctttgcagaatgctcagagaaagcgaaaaatggaacatgatggttcactttttcaagcagtaggaattgtaagtatgagtagtaggttttgcttttctagctaatgtgctatttcgtgtgtgtgtgtgtgtgtgtgtgtgtgtgtgtgtttccacgtttcttccaaatagtaaagttatattttcagaagttatacattgggtttttttactctgtatgcactggtttttaaaaatacaaatgtttaatacatacattcttggtataaaaattccaaacaattccagtgtattttgagttaaaaagtgaagttctccccttactccaccctgaatatcaccaccaatctcattctcttccctttaagttactttgccttattaaaagaactgctattggccaggcacagtgcctcacgcctgtaatcccagcactttgggaggccaagatgaggatcacttgaggtcaggagttcgagaccagcctggccaacttggtgaaaccctgtctctactaaaaatacaaaaattagccaggcgtgttggtgcacaactataatcccagccactctggaggctgaggcaggagaatagcttgaacccgggaggtggaggttgcgatgagctgagatcaggccactgcactccagcctgggtaagagagtgagagtccatctcatatttaaaaaagaactgctatgttttggggtaagtcaatggtggtataatacattctgatattttcaaactaaattaactggaaagtatttatagacagaatggtcataatggatgacaaataacttaagaaagaattcaaaataatttagggtagtatttaagaaactgcctataatgttattaaatttacaccaatttcaaggtttttggttgtttaaaaaaaaaattcaacaaactaaacttgaaataactttactgtttatagggaacattattacagcagccagacgatcatgcagctactacatcactttcttggaaacgtgtaaaaggatgcaaatctagtgaacagaatggaatggagcaaaagacaattattttaataccctctggttagtttattctttttgaccttgaacatcacaaagacaaaatacatgaaacatttttatttaggagctttaatctaagtgagaatgactttggttccttagcaagattaaaaagtaaagttgtggctgggcgcggtggctcacacctgtaatcccagcactttgggaggccgaggcagccagatcatctgaggtcaggagttggagaccagcctggccaccatggtgaaaccccgtctctactaaaaatacaaaaattagctgggcgtggtggcgggcgcctgtaatcccagctacttgggaggctgaggcatgagaattgcttgaacccggaaggcagaggttgcagtgagccaagatggcaccactgcactccagcctgggcgacaagggtgagactctgcctcaaaaaaaaaaaaaaaaaaaagtacagttgtatttcatgtgatggtcttaatacagagattaacatttcaaggtggagcttttcatttttagtaattttctttgatttctctatgtccatgtgctgtcaatattgatagaagctgaaatttgtgaacttttatgacttcttttttttttttttttttttttgagacagggtctcgctctgttgcccaggcctggagtgcagtggcatgatcatagctcactgcagtctcaaactcctgtgctcaagctcaagcaatcatcctacctcagcctcctgagtagctcgcactacagacatgcctcaccacacccggttgctttttgtagagatggggtctcactatgttgcctaggctggtttcaaactcctggcctcaagtgatcctcctgcctcagcctgtgctaggattacaggcatcagctttgatgcccaccatatttatgcctttttccaaattgttatttctttgtgcctttattgtatcctgtaaacatttctgacacagcaacagtatcactggattatacttactttttaacatagttgtggttttgccaggtaaactaaaaacccttccagaattttgctttattttctatgatacctaacacattgtgggtgtttaataaatattcattgactagatgaatgtatacttaggtatctcttttgtttttcagatttagcatgtagactgctggggcaatcaatggatgaaagtggattaccacagctgaccagttatgattgtgaagttaatgctcctatacaaggcagcagaaacctactgcagggtgaagaattactcagagctttggatcaagttaactgagctttttcttaatttcattcctttttttggacactggtggctcattacctaaagcagtctatttatattttctacatctaattttagaagcctggctacaatactgcacaaacttggttagttcaattttgatcccctttctacttaatttacattaatgctcttttttagtatgttctttaatgctggatcacagacagctcattttctcagttttttggtatttaaaccattgcattgcagtagcatcattttaaaaaatgcacctttttatttatttatttttggctagggagtttatccctttttcgaattatttttaagaagatgccaatataatttttgtaagaaggcagtaacctttcatcatgatcataggcagttgaaaaatttttacaccttttttttcacattttacataaataataatgctttgccagcagtacgtggtagccacaattgcacaatatattttcttaaaaaataccagcagttactcatggaatatattctgcgtttataaaactagtttttaagaagaaattttttttggcctatgaaattgttaaacctggaacatgacattgttaatcatataataatgattcttaaatgctgtatggtttattatttaaatgggtaaagccatttacataatatagaaagatatgcatatatctagaaggtatgtggcatttatttggataaaattctcaattcagagaaatcatctgatgtttctatagtcactttgccagctcaaaagaaaacaataccctatgtagttgtggaagtttatgctaatattgtgtaactgatattaaacctaaatgttctgcctaccctgttggtataaagatattttgagcagactgtaaacaagaaaaaaaaaatcatgcattcttagcaaaattgcctagtatgttaatttgctcaaaatacaatgtttgattttatgcactttgtcgctattaacatcctttttttcatgtagatttcaataattgagtaattttagaagcattattttaggaatatatagttgtcacagtaaatatcttgttttttctatgtacattgtacaaatttttcattccttttgctctttgtggttggatctaacactaactgtattgttttgttacatcaaataaacatcttctgtggaccaggcccctttgatcagcttttatgttcaaatattaataatatttgcttcaacacctccaactcataaaattgtttaccaacaatttaagcacttatgaaaattacatggtactggttatttctacatttatcttagtgccatcaccttaatgtatgttgagtccctaaatgtcatgttaaataataacaaccataatatcccattgaaaagagtatgttgttagaaaagaaacatcatttttaagtttctgagcctattaaaatgctcaaacacaaaatattagtatttttaaaatatgaatgggatgagtgaagcagttctcagcattatagtcacaatgttacaaaggctagagcttctctgaagatttctaatctgttcccattaacagattaataaatttagacttcaaatgaataatttgcccaagctttaaaagtaatagatggcagaccaaaaatgtaagcttaagtttcctgactctaaagtcaaacttagaacaaatttggtttgtttttgttttaatgatactgcgttttaaaacaaagtagctttatcctttttctcctgtatttttcttttacaaaatagctgtatttcttttatactgataatctcatttttaaaaatcagacagtgtagaaagatattttttaaaacagaaaaatcactatgaatccctgcacctacaggtacagaaaattatttttatgaacaaattatgtaggaagtgccagagccttaggtcctttaccctgaggtatatatactgaacaaaaggaactgagccacagatctcttaggtagctctttttatcttacaatggaggacagtgattacaattatatgaaaattttggaacaaaagttaatactaagattcagtgcaaaatttggggggggggggggcacaggtatacttaagcacaaacactgtgacccaaagtgcttcaacatttagttacagatagtagtatactagaagtggtattttagaataaagtggttgcttagtattcacaggtcacaaaacaaaaaattattcttgtatagcaaattagcttcagttgaaaactatttgtaaaagcagattatgtaatgaccaggagttcaggaaaatgacttctgaaagcattgagaagggaaagccacgttaaaggacagtacagctggaaggaagcaagtacttacccactgctcagtcactaagacaacaagctccttggagtgctttaagctacggaatagcagaactggcccttcccaattttatgcaccgtcacaaatttcttcataatggttttgtccaaggcttataacccaaccctggcaactataatccttactttatgaaacagctgtatttcttttatactcataacccagaaaaatgagaatgtatgttctgagtataaaagaaatgtagctattccataaaaatacaggagaaaaagaataaagctattttaatttttttaatgcagtatcattaaaaaacaaaccaagtttgttctaagtttgactttagagtcaggagacttaagcttacatttctggtctgccatctattacttttagagcttgggtaaatcttcatttgagatctaaatgctatatatagttcattcatagcagtaccagataagggaggagtatatctatacagtatatagtcttgaagaagtgatctaaggctcggagcttttgaggtggccatgagtgactccaaagtccatggagctaaccaccctgcagtgctagccaatccagttgaacatacccttttctccattgttaactgtttgtttaaatagcaaacagaaggcggcaatggaggtgtggaaaactgaggatccgatgtcacttgaaagtaatgagatcacataacattgagggaatgtcctaagaggagtggcagggcataaatagaaatgaataaaagtgttttcaagtgccatttagtgggttctgaatttgaactagagattgagatatccagttat

SEQ ID NO: 30 - DNA, 26277 bp, homo sapiens
tatgcttatgaatctatttaattgctcagactgtgctagagaatacgtaccatgaaatacatatatttcataaggttcagttacaaaatggattgtttcaaatggcaatttcttacactaacctgattatgaaaaaaagaagtctgtatcatctgcttccaagtctgttatgtccaaatatattttaattatgcatttattttgctacttttataaatattagagatttcaccttaaattatttttgtaactagttctagaacatgttttccaattattatttttctaatggagacatataattgacctatgtttatgcatatatgttctctacacagtgaaactttttttaaaaagaatagtaaagaaaatgcggaagctctggctctccaaggcaaagtcaaaaaaaaaaaaaaaagcgggggggaatgcgaggaacattttattacacctcctgattttcagtccttgagttttattttctccccttgtttatttgtttaatgctagaaactgtattcctaagagagcatacctctttcaggtgagcatgataattggaagattttgatacttagagtatgaacatataattaagaagtgattacctaataaagataacaatgtgactattttaattattttggtggcagggagttggttttacatcacccaaaaaaaaaaaaaagccctggtttcaaattcattggtaataaatatgctaactttctgaatcaaaatggagagcctctcaagaaaaagagctatgcagtcagcaatgacttaaattagtcaggatagcaggcatctggggttaaggctgtttccaccattttggtctcaccaccatatacgagtgggaccacagctgtgtagcacttgtttctgtcataagtgtagcaggtctctgtagcactgtcttcatcacagatattgctctgggtagcagtaactatctgattatccagctccacttctgtaggatcacattttttacagctgaaaagcaaatatatgtattagacaatcccctcaaatgctgtctcaaaatgtgactacacatttcaatccaaaatcaattagttcttgcagctctgacatgacagcaagggatgactcctttcagacataagcagctctacaatacagaatagcttatgggattttccaatctttaatatatattagttgaaagtaagcaatataattaatgatatgataatatgattgttttatctacaccatacagcaatttctactgtgttaggcttattcccaactgtatatctgtctaaacaagttatttatagtgacaagaaagggagaatttttaaaaaaattgatgttggagtctgtcatttccaaagaaacacctgcctttttataagatcaaatccacttattgaactattaagagaaattggcctttctatgaatgccaatgattttttctttagaaaaaatgtatagctaaattttatctgtgacaaagttttatgaatttatgatacctaataattaacataggaattaatgtattcaaaagttcagattatgtttgtaaatgtttatactccaacatatttttaaaaacattcttactaacaaggttaaaattaaaagctattaacttccacatctatattactatggaaaaaaatatatcttacaggtcagacaaatggtacacaaatctggttctcaatggtgaggtgggatcagagatattctccctgttgttcagaggaacactaaaagaaaagaaagaaaacaaagttaaaacaatgaaatgcagatattgttatttttggtaatgagtatacggccactatttcatcagaacagtacttattgtatttagtactctataagcactctagagtaataccgttactcagatttttatagtaacttgctatattttaaatatttctcattcaaaataaacctcacaacaactccgctgtcaactatctttgctgacttggcaaatttttgcttttcctttaaaactcaactcacgttttacctctgtaataattatattgatgttatccccacccttcaacaaacttcttcctctgcagtctcattaatgctcatatatatttattatatcaaatgccgtatcatagttgcttgtctacagagtggttgcttccctgggctatgtaagttccttgaggcaaaaacatttatgtattcccagtgcctagctaggtatgtggcatatggaatatgttcaatatatgtgaaatggacagacagatattattatccagattttagaggagaggaaatcataaataggagaggttagtgatccacccaagttcacacaacaattaagtagcaaagctggaactttttcatcgtgatgtcccatgaaaaattagatgattgtcaacgagttcaggtgatttcattaactttaacatttttttcatctaagtcatcattccttctcatgtgcagccctccctaccaaaaggaacaacaaaaaccttgtgtttcctaactcagtatttataaataccatccaagccaaaaacctggctatcatacctgaatcctcccctgtcacatatctaatcaatctcacagtccagttgattctaattattttcatgtgtgaaatccatccacttgcctctcttctcattattactgccttaattcaggacaccactatcctctcctagattgtaacaatgtcttccttttgtcttgaccccttcaaaccactggccacattattgccaaacatcctttctaaaaatgcaagcttaatttccttctctgcttaaaacctctagtgtctctccacagataacagggtatcctcaaatagcatagaaggcacgtatcctaatatgcccctaactctccagcttcatctctcacaatgtcaccatctacaatgcatgccagctgtaaacaatcacttgcaattccacaaacgtaccatgcttttctcatctcccatcttaacaataacagttctaacatataatactggttacagtgtgcctggtactatgctaagcatattacgtgatgatctcatataatcgtcacagcaatcctgtttccttttcctggaatgacctgccccacctattaattctctcactccccacacacatttagccagcaaactcctattgagctaacagccatcatccatcccaccacttattccaagcaccctttcctgcctcccactgccacccttctcctctcccccaggattggactgggtgcccctcctcagtactcctataacaacccatgcccattcctatcatagcacttacaatacagaattgtaattgccgttttaattgtttacggtttcctgttagactataaattcttttaagaaatggactatattttaaataaactgttttatccccaccaccaacccttaatatttggcagttactaaataaacattcgttgaatgaatgaatgaaactattcttaataagactgtaaagactctagtaatatcagaaaaaggagaggctactataagccaaacactgttcttttatgaattattgtatttaatcctcacaaccctataaagtatatgtgtataaattcatacatgcataattatccctttttttaaagtttaggaaaaaggctagttaagtaacttgcccaaagtcacatcattttagtaagtaatggagttgggaataataccataatggcaggctcggcatggtggctcacgcctgtaatcccagcactttgggaggctgaggcaggtggattgcttgaggtcaggagttcaagcccagcttggccaacatgatgaaaccttgtctctactaaaaatacaaaaattagccaggcgatgaggagtgcatatgtagttccagctactagggagactgaggcagaagaattgcttgaacctgggaggcagaggttgcagtgagccaagatcatgctactgcactccagcctgggcaacagagtgagactctgtctcaaaaaaaaaaaaaaaaaaaaaaaaaaaaaaagccaggcacggtggctcatgcctgcagtctcagcactttgggaggccaaggtgggcagatcacctgaggtcaagtgttcgagactagcctggccaacatggtgaaacctcatctctactaaaaatacaaaaaaaaactagctgggcatggtggtgcgtgcctgtagtcccagctactcggggaggctgaggcaggagaattgtttgaacccaggaggcagaggttgcagtaagccaagatcgcaccactgcattccaacccgggtgacagagggagactccatctcaaaataatgataagaataataataataataccataatggcacagcaatggcaatatactttcagaaatcagaacagaagatcaacacatcaggcaaagtgtcatgaaatatctgaattatctgatttcagtaaacaatgtaatataaaaagaatcatttcataaaataaaaagatgaattagaagatcatggaggagattttaaaaatctcctggaggtttaaacgtaagatagacactcttcaacatggcttaagtgccagtgtcatgtatgccattctttccaattacccactactccagctattctatccctaacacgaagctatgtgggcaggatctgagtggtcaaagaaaacctcctagaggaagtgatggctgaactaagacatgcacattgagaaggagttaactaggctaagaggggtgggacagagttcttcaaacagaggaactagcagatgtaaaagcactgtgaatgtggggaaatagagacactacagcagtgctgaatttttttttttttttttttttgagaaagtctcgctcttgtcccccaggctggagtgcagcaatggcatgatcttggctgactgcaacctccgccttccgggttcaagtgattctcctgcttcagcctcccgagtagctgggattacaggcacctgccaccacgcccggataatttttgtatttttagtagagacggggtttcaccatgttggccaggctcgtctcaaactcctaacctcaggtgatccacccgcctcggcctcccaaagtgctggcattacaggcatgagccaccgtgcccagccccagtagtgctgaatttttaaacatgaagtaaaagaaaagtggcaatggatgatcttgagagttatgctaagctttgtagatcaggccaaggcatttgtaatatatcctaaggtcaatgttggggaaaccatcacaagacttttaagcaggatggtgacaataattggcacatagattaggtgaataaataatagtaaatattttttaatatgtcccagaaatatataagctctaaaaggaatattctctatttatttttacaataatcctatgagttaagcatgatttttttcctcatttaaagatgaaaaagttgaagttcaaagtagattagtaacttgcatacaaaaacacacaactattaagtgtcccagacagaacttaaaacaaaattcttaaacacattatactttttccattgattgaatggaatggaatgctctgttctctttctataggagatttgattggggaaaaactattaaggtaggagtggtttacaaggaaaacttataactgattggatccaatagaaatctaatttctcaaatagtattagcattcttgctattgaaaaagagctgtatagcatataactctggactgtgtgtgaaatgaaatgaatatctgaaatccaatctaaaagtgagatcaaatcaaattaatgtgatcagtctgccttatctcgatgcagacatctggttacagtataaaagactcagttatctatatatggtacaaaataaggctttagtgttatctgaagtttcagtttgaactgatcaaaggcaactgaaagttctgattcaaattgaaataacttggccaggcgtggtggttcaggcctgtaatcctagcactctgggaggccaaggcaggaggatcgcttgagctcagaagttcgagaacagcctgggcaacatagtgagaccctgtctctaaagaaaaataaaaaattatccaggtgtggggtggtgcatgcctgtagtcccatctactgaggaggatcacttgagcctgggagttcgaggctgcagtaagcagtaatcttgccactgcactctagcctgggtgacagagtgagaccctgtctcaaaaacaagcaaacaaaaataaatgaatagaaataactccatataaacagtgcatgttgatgactagattacaacctttgtttataatttgatgtagcccactgattttagattggctgtaatctttcattcttacccctaatttcaataaaattgcctcaagctcattcataagactcaattctttactcatgtaaagtgctacacagcaaaaaggggagtaaagaggcaggtgttacattcaaacaatgctcagtgtcagaaagtatctctgcttagaacaggaaaaaaaggaatatggaatgccacatacataattcggatgtttctctccacaatgtcctcattaggatcttcggaagaacggatgatcctggaagtaatccgggcacacttacatttgttgtcaacaagaacaatcctttcatcttcttgggcttgaaaggtaaacgtattaaaaagaaaggaaaacaaaggtcaatttatatattttgtattgagttattttatctttcttgcctgcagaaaaatagttttatggttggtttgtctcagctttctccatttgttctctaagcagaatcttacatcacagtaaaggaaatccaaaggtactctaaaagggattttcacttttttcttgaaccagtctatgggaatctgggttgaaagaattctgattttcgcatccttcctaaactctcatttgtacttaaattttttttgtataaattgtattatagttaagaacaggcatgttttcatccaagataaccttattttgtaagacttttaaatattctctaccacaattatctgccttttcataataacaatcagattatcatagtacatgattcaatttaaaaaaaggctatatttcttataagaattattttaagcagggcgcagtggctcatgcctgtaatcccaggactttgggaggccgaggcgggcagatcacagggtcaggagttcaagaccggcctggccaacatagtgaaaccccatctctactaaaaacacaaaaattagccgggcatggtggtgcatgcctgtagtcccagctactcaagagtctgaggcaggagaatcacttgaacctgggaggtggaggttgcagtgagccaagatcgtgccactgcactccagcttgggcaacagagtgagacttcatctcaaaaaaaaaaggaaaaaaagaattattttaaaagatagagtatatatagatataaagtgctgtaaatttgcaaaagcaatttagaaatattatgaggtacaatctcaattgaatatgcctgtatacagaaaaaaaaatgaataaatgaataaatacacatatgaccattaaagccttaactttgaatgtcaacatttattgtctaatctgaatattagacaaagaggtctgataagttgtttgtttatttgccagaatgtctcactctgtcatccaggctggagtgcagtggcacgatctcagctcactgcaacctctgcctcctgggttcaagtgattttcctccctcagcctcccaagtagctgggactacaggtgtgcaccatcacacctggctagatctttgtatttttttttagcagagatggagtttcaccatgttgcccaggctggtcttaaactcctgacctcaagtgatccacctgcctcgagcctcccaaagtgctgggattacagagccaccgcacctgaccttgataagtattgcaaggaataaacaaaggaaattttgtatcatctgggtttggatcaattaacagattttattttaattttattttttgagacagagtttcactcttgcccaggctggagtgcaatggcgtgatctcagctcactgcaacctccacctcccgggttcaagtgattctcctgcctcaacctcccaagtagctgggattacaggcatgtgccaccatgcccagctaatttttgtatttttagtagagaccgagtttcaccatgttggttaggctggtctcgaactcctgacctcaggtgatccaccctcctcggcctcccaaagtgctgggattatgggcgtgagccaccacgcctggcaaattaccagattttaaaaattcaataatagctttacataagtaatgctattaaataagagtgctaattaataataacaatgatgttggccgggtgcagtggctcacgcctgtaatcccagcactttgggaggccgaggcgggtggatcatgagttcaggagttccagaccagcctggccaatatggtgaaactccatctctactaacaatacaaaaattagccaggcatggtggcacacacctgtaatcccagctactcgggaggctgaggcagaagaatctcttgaacctgggaggtggaggttgcagtgagccaagactgcaccactccactccagcttgggcaacagagcgagactccatctcaaaaaataataataataataataattacaacaatgatgttaaatatgctttattcatataattttagctaagtgacctttaacaattcctctcattaagcctcaactaaaaaaaaaacatttagtatacgaattcaagttataaagtttaaatgatcagaatagttataattttaactggaagtctattcctgagacgattcccagagcaaagaggacctaatgcagtatttcagtcttaatgataagagccactacaaaaacattttaagaccattgttattgtacttgtaattgtttgaagtactttataatgcattattataccattattcataagttcctaatgaatcttctgacactgtgtaatattggaaagaaacattatggagtaaattcaaggtaatgaaataactcattaacatctgaaagaggtaaaatgacttaaatgatgtcctctttcctacttgtgtatccatgactcttaaaagttttttctcaatgaaatataaatgagcacataatgcctgaccaaaaatatagattgttgaggagtgacttgactattaagtcttaaatagaaaatgtctatattctattacggcatatgattacttccttaccagaaacctgggaagttaatatagaaaaatattaggcagcctaatatctatcagaaatacatagctgtcagaaaagttacaaatactttcaattcaccaagacttagagtctagcatttgctctcaccaacaggcagtatttttcctaacaaacctgttattagggactgtgccttactttattccaagagcatctgacacatagtaggtgttcaataaatatttgttaaatttaattcacttcaaacaaataagaaaatagatttaacaacatatgctagatatgaccataatgagtttactaaaaagtgattgccttacacaaggcagaataggatagtaggagtgcgggctatagggtcagattgcctgggttctgcttacactcttgcttgctgtatgactttggtaagttacttcacctctgtaagtctcaactggctcaactgtatgtcagaagtaataatagtatttattctcatatggttactgagagaattaaatggaatattatatgtaaaggaattagcatgatacctagaatatcatattcagtaagtgatagctgttttatatacagatggtccccaacttaccatggttctacttatgatttttctactttatgatgctgtgaaagtgatatgtattcagtatgctcctcagctacaatggggctacctccctataaagtcactgtaagctgaaagtatgatattttcaactttcaactttatagggtttatagggaagtagccccattatatatatcatatatttttagatatgtatatatacttacattgtacatgctttactaatattttatattttaaatcattagaaagttattcttaatgctaaattagtataaaatatatatataaggcctattcttaatcacatttctgtcattattcatcttgaaataagaaccacagactcagtgataggaacaatccagacaaattttagtgtgtccttctaaatgaaaattatttaatactgtacctctaaattcagaatgtattccattttctgaagttgtttgaaagatcagtaaacaaaataacaaaagttcagtcatcaatttataggcaacctgtataacattaaacattgttaaagggtcataataaatctgtgggatcagatccaggaaagctgttaaaaccaataccagcctctttggggaaataaaatcccaatgcattccatgttgtacttacagtaattattatttcatttctccagaatattaatttaagagactcaagggaaggattatagatttttaagattcaatatggacattcatataagcaggactatctgtagttagctaatttcttattctctagtttgtagtaggcaaacaagtaagtaagataagagaaaaaagaataaaaagagtcttatctatgtaaagacaactgccatagaaagatgaaagcatgttaggaaaaagtagctggctaactggccaaccaaagcataggcataaatgtttaaaactgaaaaacagatctgtcctatatttttcctttgatctgggatcattttctaaatatcacatacctttcacatgaacagccttaataaaaaccgccaggactccccagaaaagcaaatggttcttcatcttgacttcacttcttctgaaaaactggagcaaaaaaagtcagggttaaggtgtgtgatctataaggagtgtgcaaatgatggtgcttctgctttcttaaaataacactccaggcagctaacaaactaaaaacaatcacaactgtggttgaagtctgaagtttaaatgctgaactggaaaaatgtatgactcacatttaagtattttcttgcaaagcatccaaataaaaaccataatttgatacaatcatttttattttgcatttacactatataaatgtttaaaccagaagactaataataatttcaaggaaggattccattaagaatgttgaaatagggattttccattttattacctagatatattcatattagtcttcaaatcagacatctgacacttgtcatgcctagaataataaatgaaggtaagtgaaggaggagagatgaaggaaggggagagaaatgaaagtcctttaaggtcccaagtgtatcttatgttaattttttatactagtccttaattaaccaagctaccagatttaaatatatattttgtatatatctcacaaaatatgtattttgtatatatctcacaaaatctgtattttgtatatatctcacaaaatctgtattttgtatatatctcacaaaatctgtattttgtatatatctcacaaaatctgtattttgtatatatctcacaaaatctgtattttgtatatatctcacaaaatctgtattttgtatatatctcacaaaatctgtattttgtatatatcttacaaaatatattttgattactttcagttattttataagctcaaacatggaattggaattagaagctggtagatacttggctgggcgcagtgcctcacacctgtaaaccctgcactctgggaggccgaggcaggtggatcacttggggtcaggaattcaagaccagcctggccaacatggtgaaaccccgtctctactaaaaatacaaaaatgagctggacatggtgagggcctgtaatcccagctatgcgggaggctggggcaggagaatcgcttgaatcttggatgcaagaggctgcagtaagccgagatggcaccactgcactctagcctgggtgacagagggagactctatctcgaaaaaaaaaaaaaaaaaaaaagaagcgggtatataccagataaataagttgccatattttaatttgatagcattaagacggaccttctgtctagttacacctttcagaattgcaaacccataagatgatttttgagatgcctcaaaagcaaactgaatcactgcagtattttgtgtaaaatttttttcacttaattaatgtcattttttttaactgagcttttggacagagcaccccctgcactcccactccaacatgctggaatttcctgtctcttaggcaaggttggttccaagaatatgctggttacacaacagcatcaaatccgtgttacttctggttctcagctctaatttttgaagggactcctagaattttaagaggtaattaggagtacttcagaatcataagtaaggcaagcagacttcaaagctagaaatacgaaatgacaggatgaaagagacattaaaggctagcacatgattgcacttcttcagagtatgtattgaaagtctgtaagaacaaagtgtcaggcactgtcatacgcaatattactatactgtccaagtttattcctattttaatttctactatcagtaggacttagcaactacttgagtttagggaaaatatactggcatcacatggacagtttattaaaaaaagaaacagacctgaaagcacattattttagtttgtggtcaggaggtcaaaacaactatcaaccactctaaaagatcctcacccccaactgaagtttctaaataactgacttattcaatcactcaaaaaaaaatagtaattaatagtcagctggatacctttttaattcttgaaaaataaactcaaggctagactgccttcccaaagcaagttgagtaaatccttgggaacaaattaaaacttctccaaaagtttccttttttataacagcaaagattatttaactcataattactaacctaaagaaaagctctatatttgatattttcattcttccaatcttgcttttttttttttttttgagatggagttttgctcttgttgcccaggctggagtgcaatggtgccatctcggctcactgcaacctccacctcccaggttcaagcaattctcctgtctcagcctcctgaatagctgggattataggcatgtgccaccatgcccagctagtattgtatctttagtagagacggggtttctccatgttgttcacgctggtctggaactcctaacctcaggtaatctgcctgcctcggcctcccaaagtactgggattacaggcgtgagccactgcgcctggccaatcttgcatttttatatttcgattatgtaaactataaatctaaaataaattgcgttaataaaaataaagtgtgacacatttgtcattagaagagaattacctatgctggcaacataggatctggactagtgttttgccttgtgtgctctagggatcatctgactagaaccacttgtagtactggttaaaatatggatttcttggtaacactcagaatttctggagatgtgaccttggaatatgtattttcaaaaagcatcccagttgattctgatgtgcactgaagtttgaaaactaatggaaaaaaagactggcctagggcaggaagtaagggagtgcagaataactagcagcaataactatttatggaagaacaaaagattaataaaggtaatttttaaataaatagccatactgaaaagttagctgaagtttgtatttgcttataattcactataggtaagctgttgcatattctttttatcattaacctactatatacaaatacaagttccagtttaatttttaaaccacttctttgccagttttagttatgtttttgccactaaaaaaatgtcaaatgtgaatagtagaaccctttacatgtgtgttaagtgattgagaacttagccatgtgttctaaattctcagcaaaaaaagaggcttatttttctatactcacatttaagatttgtgtagtaagagattcagtgatagactcagctagatgaaagagatcttaaaggtaatttagtctcaccttcatgactctcaattttttttcaatattctatataaccgaattcagcatttagttgaaaatcatccgaaatagttggatgctccactccctgtggacacaactcattatattttgggatattcaaattgtgacaagattttattctcatgggacacagagaatgtaactccctgttttcctcctgtctcactggtgactccttctgggtctcttgccaaattttcctctgaatattgaggacatcaaggcttaatcctcatcttttctattctcttagcctctccttaattaattttaccttattccatgcctttaaacatagggcacactgaggactctcaaatgtataactttaacttttaccttgcccattgagttctgaatgcctatgtccaactttttattttatatctccatgtagctatctaaatgggtatctaaacttaaccaggtaaaacggtattcttgatgaccaatccatcctcacactcacataccaatctctttctgtctcaagttttcccccatctcagtaaatgacacctccatcagttactcaagccaaaatcctcttctttgcttcctttcttttcctctcccctacatccaatttaccagcatgacctgtcggctttctctccaaaacatatcccaaattcatctgattctctccgttttcactaccaacctagtccaagcctccatcctctttcctggactaccataatagcttctataattaaaaagtaacttttcctttccctcagcattggtgactaaggcacacagatcataaacaagaatgactaagtaccacaaatctaaagcaagccaaatatttcctccaaggtttgttaagaggcaacgaagccagacacagtggtgcatgcctgtagtcccagctactcaggaggctaaggcaggaggatcgcttgaggccaggaattgaaggcaaggctaaggaagataacagtagttttcaatgtataactattatgtacacatacaatttttttctaaaaagaggcaacaaaactcaatctacttccatcaaccaccactccaccgctcccatacactcccatctcatctttagaagactagggagggaagaggggggatgttataagagcagctgttaccttgttgaaatcatagtgtttgtaataagagactcccacacacatatcccacctcgcttcacccttgggagagtagagagtaaaggtggggcaccttcctctccccagattcaagtgagggagagtttcaagaaaatcacccaagagatcagggaccctaaaagcaggggagattgagaagcaatatagcataatagttaagagaaagggctctgaacctgactgattgggtttatcccccaattccaccactctctagctaggtaacactggacaaaccttgaacaaatcacttaatctctcttaatttcctctatctgtaaaagggggaaataacaatatatgcttcacaggattgttgtcaggttaatatttattacatctattacatcatgtgaagaagttagatcttggcacacaataagtgttatgtaagtactagttacttattattatcatcgtcgtcatcattatgtcttaactccttgtggagttgcagaaaatgcagctaccaactgcaatgaagtttggggaaagcattcctgggagaacctgacatggccccttgggttgtggatgtgcaggaatatcaaaaatgatacatgatcatgctatataaagtataaatgaaaatgtccaaagtttccaacttaggatgggtgaggaggaagttcacttggaagatatgttagctttatttgtaatagcctaaagctggaagcagtctaaatgtccaaaaacaaattggataaacaaattgtggtatatccattactcaataataaaaatgaataagctattaatagacacaatatggatgaatctcaaaataattattctgagggaaagaagccagataaaaatttttttaagaaagtacaggctgggcacagtggctcactcctgtaatcccagcactttgggaggccaaactgggcagaacgcaaggtcaggagttcaagaccagcttgaccaacatggtgaaaccttgtctctactaaaaatacaaaaattagccgggtgtggtggtgggtgcctgtaatcccagctacataggaggcggaggcaggagaatcgcttgaacccgggaggcagagtttgcagtgagcgaggtcgcgccattgcactccagcctgggcgacagaacaagactctgtctcaaaaaaaaaaaaaaaaaaaaaaaaagaagaagtacatagtgtatgattctatatttggatatatttatatttttttctagaaaattcaaacaaatgcatagtgacagcagatcagtgattatctgggaaggtggggacagagagaagggaaggcgggactataagtctataaaaggacataaggaagcttttggagatgatgaatatgttcattatcttagtggtgataatgaattcacaggtgtacacacatgtcaaaattgatcaaattgtacagttcaaatgtgtgcagtgcactgtatgtcagttacatctcagtaaagctattaaaaagttcacatcttcagaattcagttttttaagtatgatgttaggtttttcttgggtgccctttaccaagttgaggaagttcccttctcttcctggtttgctgtgagtttttatcagaagtgaacattgaatatttgtcaaatattttttctctgtctattgagataaccatatggttttcctttttttgtttaatatggtgaattacatttatttttaaatgttaaactaaccttacattcctagaataaaccccacttagttatgatataacatccttttcataaattttgaattttatttaccaaaattttgcttagaatttctgcttttatattcatgagggataattgatttaaaatgttcttttcttgtaatgtctttgcatggttttgttactacaataatgctgtcctgaaaagatgagtttagaagtatttccccctctccaattttctggaggagtctgtgtagaattagtattatttttccttaaatgtttggcagaattcctccagtgaagccatggcctgggaactctctccaaggcaacatggggcaatggtctccttatttgtttccagtctctccgaaatcactgtcctgcattgcctaatgtcttgaaaaccagtgtttcttccgcatgttctcactcacaggtgggaattgaacaatgagaacacttggacacaggatggggaatatcacacaccagggcctgtcatggggtggggggagtggggagggatagcattaggagatatacctaatgtaaatgatgagttaatgggtgcagcacaccaacatggcacatgtatacatatgtaacaaacctgcatgttgtgcacatgtaccctggaacttaaagtataataataataataataataaaaagaaaaccagtgtttcttaaattttgtcagttttttctagttggttcaaatggcagggaaaatctgcaccgttattccatcttgtttagcattggagacttgaaattaagagtgagtttgagatacaagcttttagactgaactagacttttaaaaaatgagctttactatttatggcacttttacaatcacagcaaataaactagattttttaataatgaaaaaatatttttaaattacggaatcttcttaaaacattgtcaaaaaggcaaagaaaaattcaattatagtaattgagaggcaataattggacgaaaatatggtttcatgttataactcattaaactgttcactgttccaaactcttctctagtcttacctgccacaattcattgtccacttaccatgaaaagtgatcttttcaaaggtaaatcagatcatatctgatttaaaaccctccagtggcttctcattacacttagaataaattcagagtcattagccttcctgatttcctgcaactcccccttccactcatctctctccagctactctgctcaaggctttcgtattgtcttagtccctctgcctgcaacactttccatagccttgcatggctggccccttaccaccaagtctcaattccaatgtcattgcctcagagagaaattttctggctgataatcttcctaaccaattaccaatcattatcatattgccctgttttattttcttcatagtttttattattgtttgaaattctttagtttacttagtcgtaactgtctcctcctcattaaaataaaagctccttaagagcggcattgtcttgttgcttacttctgtttccaagaacaagcgcaggattgcctcaagtatattgattgaatgaaggatgaatggagaacgtttttacaaggagttgaaaactgcctctaagtttatgtcttctaacaatattagtctcttttgtggataggctccatattgtcaatgtcctatttaaagagtagtatctagatacatattcaatagtcaagtgtaatctggacagtacaaacaacagctgaacttaacatttttcaataaatcccacttaagatgataatatctcttttttggcagctatgttacactattggcttcaattaaagtgtacaatctcatttttaaaaatatgtttctataaagtaatgactttcccatatttaaaatttaaacaagttaggatttgggcatgagatttagcattggtccctaagttttatcttgctaaactcagaccaacattacaatgtctcagattctttttaaatccagattcagaaaccttgcacattagttctttctctcagctttacagtatctgcaaacttgacacatgccatcggatccttactgaagtcattaagaaaaatgtttaatgggatagtgcttaagatagacttttgcagcatacatctaaagtcctatctctatcaatatcagtccattaataagcacattttgggtgcagtagttcatctcaagttaactcataatccatactatcacacagactcaaagtctgggttttatccataaggtaacatgaatacttatcataaaaggccaatctctcctttattctctattttaatgtcatctcatttctccccttgaaagccttccctaatataaaaggagtcttgatagcagcctggcattttgccacttgaactcttaaaagggacgatgatattttttaacaggcttcttggccttaaatccaaaatgcagctgaaatctcttgattttccttttaatggattaatttctacatttagtgtaataattcacatttcccatttgtccttgaactttatatggaaaacaaattttactaataaatagtactgcttaatcagctctaaaaattaggagggaaaatatgaagtctacaagaaaccttgaattaaatgtcaacctgtaaattccaagtaacccaaaaatcttttagatttagaaataacttatcagtgttcccaaatgtgctagaaaaaagaaatcctttttgtgtgtgtgataccctaaatatatctgacagaatcttcagtattattataagtggtaagtgaattgaaagagcatcatcagtcctggatctccctaaaaagtatcgtctttcatttccttagcactctcatgaatatattccagaatctatttatttcagaggacataaaaagaaataattttaaaagaatactgtaaaatgtatactcgagataagcattttatatctgacaaatttacaaagtctattacagaggaactccatgactacttttacaaccaggtatatataacaatcccagaaacccagaattaaatgacacacttgcaaggaatacagagaggaaagtaagatatttatttccctaaaacatagattctaaaatatgtcaaatggccattgaaagcacagcctttaactcttctccgtgtataccatctctctaacttctatacgtttgagacactagacaatacaaaagtaacttttgaatcaatccagagaaataaactgaaggaagattctattagcactgaacgaaagatctgctgccaagagaagctaacagcaaaaaccatctccactccatcaaaaaccatctccactccaacaaagtggaaaattcattatatgtgtgtgtatatatacttatcatgaatatataactgctattaacttaatactacaaaactaaaagtccccaaatatcccagaatttcacaaatcagtcaagcataaaattactaacaaaggataaagaggaagatgttttttgtgttgtgtgttttttgttttttttttttttgagatggagtctcattctgctgcccagactggagtgcagtggcgcaaccttggctcactgcaacctccgtctcccaggttcaggcaattcttgtgcctcagccccccgagtagctgggactacagacatgcaccgccacgcctggctaatttttgtatttttagtagagacggggttttaccatgttggccaggctgatcttgaactcctgacctcaagtgatccaccggcctcagcctcccaaagtgctgggattacagatgagagccaccgcgcccagcctggttgttttactatgacaaaactgaggtatagcccttgatctgacaatcggtcctcctaccaagatccttgctgggttgctctgaacttcctaaaactcctatagggcactctgtgtccaaatccacaagagcacacatgacttatctggaataattatcaataaaagttttaaaatatgtttaataatattaaggagtacagaagcaattgcaactatatttgcaatgtttgggagggacattattctgcctaacctagagtcaggcaaacactattccaagaaaggaaacaacaagtaaaaagcacaaaataagaaagagcttggcccacacaggatgaggagcaggaaggaaggcacttgtagctgcagcagagtgagggggagaatcatagtagataacaacaccatgcactttataggattaacttttttcccccattttttttttttttagatggagtctctctctgtcacccaggatggagtgcagtgacatgatctcggcttaccgcaacctccgcttcctgggttcaagcgattatcctgcctcagcctcctcaggagctggaactacaggcataaaccaccacacctggctaattttcgtctttttcagtagaggtggggtttcaccatgttggccaggctcatctcaaactcctgacctcaagtgatctacccaccttggcctcccaaagtgctgggattacaggcgtgagccaccattcctggccttttcccccatttcaattgtacaagcttagaatctattttgaacttcagaatcaatcttagtcattctaaagctaaaggtagagagcctaagcctcttaacttacagtccattttacctctcacaataccaagagccattaatactattttttcacatctatatggagaaatttcttctaattggcattttttgggggtgggggaattgaaagattagactgaatcatttcacaatgtgatgttttgattatgtataccttgtgaaatgatacaaaacttagaaatctgtaatttaaataagtgaaataatcaaaaatgattttgtctaacaaaaatgctttagctggctgaacacggtggctcatgcctgtaatcccagaacttcaggaggctgaggttgatgaatcacctgaggtcagaagtttgagaccagcccagccaacgtagtaaaaccccagctctactaaaaatacaaaaattagctgggtgtggtgaagtacatctgtagtcccagctacttgggaggctgaggcaggagaatcacttgaacccaggaggaggctgcagtgacccaagatcacaccgctgcactccagccttggcaacaaagcaagactctgtctcaaaaaaatatatatatatttagctatttttgcagagatatacactgaatgattttttctgatattatataagcattgaatgattaaaagtcaaacagagcatttttactcaactttgataccctttgataccctccttcctaatctttgtgacttccaacctcattaaatgtctgataatactaactgccattttttaaccctaaacattttcgttcttatatgcagagtttcttcaaatattgatctctatccaagcacagtgtatgtaaaatttatatttagatatcaggaggcaaaagctggtcagttgggtgcagtggctcacgcctgtaatcccaacactttgggaggccaaggcaagcagatcatttggggtcaggagttaaagaccagcctggccaacatggtgaaaccccatctctactaaaaatacaaaaattagctgggaatgatggcgcatgcctgtaatcccagatactcgggagctgaggcaggagaattgcttgaacctgggatacagaggttgcagtgagccaagatcatgccactgcactccagcctgggcgacagagtgagactccatttcaaaaaaaaaaacagaggcaaaagctgaatttaaaaaaaaaaaccctcaaaatatgaagaagaaacttcattccaaattcttactaaaaattaaaaaatacaaaccaaaaaattgacttctttttctcgaacagctttccacatagacttttagggtagtccttctgtggttaaatgtttatgaggagaattgcacctgtgttgtggtcagcttttaaataaacttgcacctgcagtggtttttcatagaattgctgtttgagaaattacatgtcagtggtttgaccatcacacagagctatttcccttcaccatatcacctgccaggcaggtcctaatttaaaaagggcctacttccaaaaattcatttgaaaaaaaatctggttagatttcatggtaatctctccagggacacaataataagtaaggtttccaggatacccctcaaacaaaaagaatatgctcccttcaattcatccattgcagtggtctggtccttctctgctttaagaaaacttctgatttctggagaggcttctgctctagtcaattatgtctgctttccttttcctgtatattatctgctaattcctgtttcagaatcttttttagtttgtcattttccttaccataaatttatttctctttccttcctgttcatcctcataaaaaaccctaaaatctttcaaactaattcaagtaggtctaaatgtcattccattctgttcactcttttactttgtttcttcattgctaataaattcatcttgtatcttgtataccattttactcagctggcatattactttatcacttttcttcatatgtgtgtaattttatatattaatgttttctagatgcagagaggtgttcataaagagcaatatcagatggcaccccaaaaaaggatatgaaagaacaccaaaagggaactctaaagatttagttggaaaagtaggtaagaaaatacaattttcttgttctaactcttctattcagagtgtttacatcatatgtaagtgccatactaagttcattttccctaataacgagaaagcataaatctgtggtgaggaatatccagtcagttatttttaaaatatcagatgcaactgtaaagatgtgtcttaagagacacttctacttagtcttcctactgaacaaaagagcaaacgctgtggagtcagttattgcctgggtgcaaatgggactctgacaagttataaaatcttgttttctctgtttcatctataaaatgggcatcactgtagtacatacttcacaagattgatgaaaattaaattgataagtgtaaagcatggaatatgctagaacatggctacaacatataaacaattactttagcataatgcttagctcttgatctgcctacttttcatatccatattcccaggaccctgatttagacacaaaaacgcatcactctgatgactatcaccatcttgcaccaacttccttctgtcaattttccaatccttccctgtttaaaaccctccaatgattcccctttgctcatagcataaataatatatctctacccaaaatagatatagatcaagatcacatttgcaaatagcttattaaattcttaggtcatttttaataatttctaataccttattgaaatttaacagagcttggtttttttttttttttttttttttgagacagagtctcactctgttgcccaggctggagtgcagtggtgcaatcttggctcactgcaacctccgcctcccaggttcaaatgattctcctgcctcagcctcctgagtagctaggagtacaggtctgggccaccacacccagctaatttttgtatttttagtagagatggggtttcaccatgtgggccaggctgctctcgaattcctggcctcaaacaatgcacctgcctcggcctcccaaagtgctgggattacaggcatgagtcactgcgcccagccaatccaagcctttttaatttgacacctggagatatgtagtcctataactctagtagcaggtaggtagtataacacttttggtctactagttcacgtgtgctagttacttaagtcagaacaacccaaaattatattttatttgcctttagttaaatatcaaatatggtcccacgtttcaactgaattttaaagacatcaaaaatttctttctctaaagagatccatatatcaaaccatctagaagacatctagacacttaaatagcttcacagacacctcaaatcaaacatatacaaaacttaacttcccatttcttggcccctgcttaaatcttttttttttttttttttttttgagatggagtctcgctctgtcgcccaggctggagtgcagtggcgtgatcgcagctcactgcaacctctgcctcttggattcaagcaattctcctgtctcagcctcccaagtagctgggactacaggcatgcaccaccacaccaggctaatttttgtaactcctggcctccaacaatccacccacctcggcctccaaagtgctgggattacaggcatgagccaccacgcccggccaagacaagtacataactagtcttaacacaaaggagaaaatgtttagaaatccctaagaaaggaagagttagggactattagatgttaatagaatgaagtatatcagagaagacagcctagagaagacacaatcttagctgggccttgaaggccatataagcattgaaatatgagacagcccaaagagaggccaagagaataaaaatctcaaaaagagaaaaaaaaatgagtacatagtttggctagaacatataattcatgaaagtgggaaagcagctggaaaaataagttggggccagataaaggcaggccctgaatattggcttagagataagaacttgattctatagagaatgaggggtgactaaagaaaaaattttaacatgggctgtgtttcaaaagaccttcaccaccaaagctataattatcactgggtcaatatttaaatcaaaataattgtagttacaagttttcccatgaaaagaaaaaactaaaagggattaaataatgtttagaaagtaattgccaagtttttagttgaattagagtttggaagggaaagcagtgtcgtaatttcactaaattcttcattttgtaatgaaggctaccaaacctgttttctagatgcagagaggtgttcataaagagcaatatcagatggcaccccaaaaaaggatatgaaagaacaccaaaagggaactctaaagatttagttggaaaagtaggtaagaaaatacaattttcttgttctaactcttctattcagagtgtttacatcatatgtaagtgccatactaagttcattttccctaataaggagaaagcataaatctgtggtgaggaacatccagtcagttattttaaattaagttaaattaaagattaaaagcttcaaatatttaccaaatatttcagtagaagctctatattttacttccaagtc

SEQ ID NO: 31 - DNA, 122218 bp, homo sapiens
tttgccaaggtatatacacgtttatttaaaaaagtttacagttttcattatacacaactattaagaggttatagtcagaggaggcatgtgtcctgttgacagacgtgcctactagatcatcacaatgcaaggagaaaggtggaagggaggagacagggcgaggaaaaataagcgataaaaagcttcagatttcagttaggggctggcagtcccttttatcttttcaagtatcacacaatatgtaccaaatacaatctgtaaataatggccatttcttcccaagcccacagccaagatgagtgttaggctaaattcagagccctggctcttcctcagatgagtggaaaacctgcgcatgacagggccggctcccccttctcaaagggcttcctcccactcatcccatccctaacagaatcgccgaggtgttcacgggccagagaaagcacaaacatggattcagaagtccaaagaaatgcagttcgttgcgcccaatcagagatagatgatttcattcaacaaggctggaagcccagttgggaagtcgataaaaaatcttgctaacttttttaaatggcttttacttttctaagtcactgaaacaaggaagggccacatgccatttaaaatcaaacactagttcccagagacttggtgtccagaaacttgacccacagaggctagcggaggatctgtctttcatgattctcagccatcccaacgggaggcctaacataaagcatgtgccaggccaatgccaactaggacttcagggggcctttggagggaaaaattcctttgagaggagacattcctcaggagcttagatcagccagctggcagtcagaacagcttttgaagtggatgagaaatgttaggtactggagagatgatatggcaactcctgataatgacctcactaggataaaatgctggttgaaactgcacagtaacctcaaggagggtgatgaaattgacgacaaagccaaatgtcagtgtctaagatggctaccactgaccctgtgcccaaaagccccccggtgctggggcttccagagggagcccaagggtggtggattcaatgttgccaggttgcaaccatcttgcttgttggtgtttggcaagagcttgagctcagttatgtgaacaggggcaaagaatggcttgtgctggtaaaactcaagggaggatccaaaaactatgggcactaaaaaggggagggaaaccgccagaagtggctctgacctgctgccgctgccaccacctctaaagccaagaatgtagagcctctgcccagggatctggatgctctcctgagtgttggaagggcagcctggaaaggcatttggtggtgaaacaccgctgctccagacttacgctaccatctattgttgggggcccagagtccttggattcactgccaggccttcttccagatctttctgtacctgtgtgtttgggctcctactcccacctctcccaggcgcagggagaggacaaaaagcataagggactctgttcaacccagcaaaagtcagtttcccagtggagaggcaaagccccacccagaacataaacatgcatgggaccaaggttagtgcccagacaggacagacttgcacagaacaagagggcacagtgggatccatgcggcaattacaggagcttccagcactaacagaggagccttatcccaccttcatcacacacacttagatggacacacacacactctcgctcacactctcacacatgtgcacacatacacacactctctctctctgcagccacactcaaatctgctaaactcctacaacctcccccagcaggtcatttgacaattctgcatcttccgctctctggtgctggggctctggtcagaggcgagccaatgtcttatcattagagagatgtgggattaggtaaggggcagagtcatggcactgctcacacaccttcccgaaactggggtctattcagttttttgacaagatcaaaagcaattcttaactggtcattatttttttttaaggtaattagaacactattgtttatacaatattgaaaaaatacaattttttattgtttgaactcaaatcaccacccagcactttaagcctaccctaaatagcacctacaataaatgtcatagcacaagcaaactgcaaagtcagcaggtaagcaagttagacagtgccagcagagagaccctccctcccccaaagcaatgagaagacagcgtgctaggtaagagtgaagtacaccattacatgttaaatagttaatactacccttccagcaagccacagatgctagatggataactcagtacggttaactaaccacagccctacatcactgcacttttttttttttttaaagaaaaccttttgcttcatgcccgtaattaacataaagtaagtaaattctttgtctttttatttaggaaaataatcatgctaaaagcaagttgtactttatatagattttcaaacaaaagattgattgtgctttttgaataaaaaagatagggtatcttccaacctcactgacttaaaccttgtggaatacagcacttctaaactaaaaacacacgtcaaaaagaaaaattaaataatcccagtgggatgctcaaaaatcgtctttagaaggttttaggattggctaattctgctattatcttattggctgcggcaaaaaaagaacacagagctgctgtctaaaatttctccaaactcccctccgagttcagcaggcaacactcagatttgaaagaaactctgcagcaacctggacatatggttagctgagtcgacatttgattagcaggcattttaaactgatttcctcttaacatacgcaggagagaaaacattttcttcctgcagggcatgttctactacatcatatttctgaatcccttcttcctattcggtcactctctgaaaaaagctggtttgtttttcccatgtagaatcactctgggtacaagaacctttatttgttccaattattatttgttttaaatttagaacctgtgttgggtctaaaatacccatttcccactcccacaagcagatgatgaccaggctgctgccaagagcagcagaaaaagggaaaaccaaaccagaacatgaaggcaagtacccagggctttgcagtcaccacgtgggtcgtcttctcaagtctaatggtccatgagcggcttgtccaaggaggcggccgcctcttggtaggtgaagatgaaatctgcaacctttctaagcacaatacacacacacacacaccaaaaaaataacccccccagaaacacaaccctcatatttaaagctcttaagttcagggtagcggtctcaaactgccaaacactaggatgaggatgtgactctgcatgtgttttggatgagaggaagcatcgtcccagtcacttttctcctcctgtgctgtcctttcaaaaacaggtctggatttcacgctctaccccaagaaaaagaactggttcagaaaacacttccccaagtttctccaacagaacactgtggctgcagggcctggtagtgtgaagggcagcaactgacatataaaaatgtacttaaaatcagagtcaaaaaatggttttaagttttaatactcttaattagctccctgctttatactgtaactccacagaagacatagggccacctaggattcacaggaaggagcagctctgattcttacatggctggctccgatgcccccacagcaggcctcttcctccccaagtttttcctctccatttcaaaaaagcactattttatcttcacatccaagagctggttggtttggtttgtttctttggaaaccaataaaagaagcaattttttcctgttctttttactcacatctacctatcagagcggctatttccttcgacagttcagtagcacacaggctgacttggccacatggactcatgaatgcatgcattcagaccgcatattgctaccaaatggaatgtgggaatatgctatgcacctcaggttgagaaatgaccaagaaatcaagatctaaagggtgatatataatatatatatatcaatgctattattcataaaaaccttgtttagtaataaaaaaaattgctttgtttaaatatgaatattatagtctgcttctcatggttaggaaataatagtctttctgaaaagcaggtgctttttctactacaactccatatcctgggcctcatcttcggaaaagtcagacatagagctctccgatgagctgtccccggtaccctcttcctgttctttcagcgcctcctccgtggcgtatttctggatgtactctgcacggggtgggagaaagacaacaagggcagtgagtgggcaggcatgtgctttggcgaccccaaaaagctggcaaggctgcggaggttcaaacttaccttgaacaccaggggggacaaagatgacagtaatcatgatcactacagctaaggagaatcccatagggagacttctttgggacagggtttctgcattttgccccctgaggaaaggggtattgggaagagcaacacagcaggctcagcttgcaggggaatgtgtgtgctgcagcaccccaagaactcttcagggaccagggaaatgggagccccacgctttctttttactttcatctcccagatagtataggaccagtcatgattccatagtaatttataaggaaatccttcatcatttttagatctgcagttacataattacggtcagtccaggtctattattttaggaatcgattttagtctaaacagatcctgcctgtcaggtttttgaagcagctggcaaaaaccatcgctcaatctgctcaggactaagctgctatacggagacaccactcggctctgagtggtttttccatgtataatttacctgaaggtagatttccgctgctacagccttggtggaaccctaggctgaataagactgctgaaacggcttttaagaactgctgaataaacaaacttgttcctaaaaactctaagtgcatactgttttcaagtgaacagcctccacacaataggaaaagacatgacagaaacctattcaaaatgcaagccacacaaaaacacacccttgtggctttgtttttcctcctatagagttgcggggactcactgcaataggaagataagctgaatggccaaatgggcctaccagatttgaataactagcacagggcctagctaagaatgtttttatattttaaaaactgtcttaaaaaataataaacagaatgtgtgataaaggccacatctggccaatgtggtcctttacagaaaaggtttgcagacttgagacttagagcccttcaaattcattataacaaaattttatgctaatgattttgatgagattaaagtagcccatgattaggtaggaatttaccttaattgagaaatatttattcaaactttaacaattttatttttaacctctaatgggttgactattttgcgtcttcctttgtagaagataaatattgacctttttttgacactagaatttgatactatcagccctctttaatgtattcaaggaaacaaatgtatattaagtacttactaggacaaggcctttgagagagagaaaggaagagcaaggtcaccaatgaggaggaggaaacagaggaagataaaaggagctgctgagtgtcaccagagggaagcagttacggacgaaaaacggccgaggcagtcccagccacactgacccccaagtcctgccagctatggcataggagaggccactccagggaaaggctttgttttgttgaaagtaagtggctgggatgtttaaacacaaccttaagagagaactatggccaggtgcagcggctcatgcctgtaaacccagcactttgggaggccaaggcgggtatatcacctgaggttaggacttcgagaccagcctggccaacatggtgaaaccccatctctacaaaaatacaaaaaactagctggatgtggtggcacatgcctgtaatcccagctactcgggaggctgaggaaggagaatcacttgaacccgggaggcagaggctgcagtgggccgagatcgcaccactgcactccagcctaggcgacagggcaagactccgtctcaaaaaaaaaaaaaaaaaaaaaaaaaaaaaaaaggagtaagggcaaagatgtagattccactcagtatcagagagccctgaatggcaggcaaagatgtcacccagcaaagggttttgagcagggaagtgacagctttagacagctccaatggtgcccagtgctacgggctatccaatatttaaacactttttcaaacatgtactataatacagcgccaactaaatatgaacactgactgtgttagctgtgttgggttggtggtgactgccacacaaatggaaatgtccagcagcagcttgggagagaggccaggcctagacacacattcagaaatcatctccctggaggggactgactgaagctgtgagaggtgaaacagctcctcagggatgacaaaggaagagagggagcccagggaccgagtcctaagtgaatgaccacatttaggaaatggaatgagaagtttccagaaagatgagggtaaaatgtaacacttgcagaaaggtccagcaaaatgggacttgagaagagtccaaaggattgggaagaaatgagggcacagattaagcagaggaggggaaaaaaactagaggagtttaaggtgaggacgcaagaagtttgaaaatgaaaaggaataaacagcatgactcctaagagagcccacaggagcagatcactgctcctgaaacagggagacctctgatggggtggaggaggaagactgcattgggagggggcggggggttgggggaacaagatcacagattggtggtgggagtgagtttgagaaatgaggaagggtgtctcttatttatttcctatagttaggaacaaagaaaagatgcaggagggaagggagaagatatcaaggcacagtaggaagtgggggtgagctcaggtctgatggccatgattttctgagattactaaggaagacaaaatgatagccaacatgaacatttccgaaggctaggggtccgtacgctggagtgagccattctaagataaatgtaggctcggttctttttgtaaatgggactatagcagacatgtactgaaacagggctactgctaaattgttgagacagaatgcatatgtgaactagagaaatatactctgctccaagatatctgtggtttgcagacattgctaagtgattcctatgtcaaaattttaatatagtctcataacagcactttatctggctgaaactgactgcctttttcttcaaatacatgtttgcttagctatatattttgctacataaattagatattaatttgcaaagcacttgagatctaattaattatagtaaatttatttctgctttatctcaacaacagctccaaacaataccctatagagaccttggaagaagaattagaaaacaaatagaagaaaagctattgtttcatgaatagtccctgtttgcctcatacctgcacatttcagagtgaagacctgcacattcaagctctggtaaattacttctactgccacctcttgcaaatgtacctcagagaggccacacattttgaggaagcaaacattctggactgctatgcagataggcccatcatgtgaaaaactggctagatactaatgcctgccattggttaaaagcagcaggtatatttcacaaactttgaattcctttgcttcttggtggagcttcatgtatctagacttttcactatgaaagttctgaaacatacacagaggtaaaatggaaaatccaatgaacccaggtggagctttagattttttttcttttttaaagacagaatcttgctctgtcacccaggctggagtacaatggcacagtctaggctcactgcaacctctgcttcctggttcaggcgattctcttgcctcagcctcccgagtagctgggactacaggcgcgtgccaccacaccaggctaatttttgtatttttagtagagatggggtttcaccatgttggccaggctggtctcgatctcctgaccttgtgatccgcctgcctcgggctaccaaagtgctgggattacaggcgtgagccaccacggccagtcgcaaacttatcttcatttaaatgaaactcatatcccatcagcacgtaaactgttttaaggatgggaaaataggattctaaatcgcaaaggatgagcaaactggtgctactgccacccgaggttggtgagcactacttcagcccacagctgtctctttttaggcctaagaaaaagtattaggaactaagtaatttaagaaggacttttaatgactgaagcccaacagatttaagttcttttgtctccaggttaaactacccatcctcttacctttaattttctgcttgtattcttctggtcggtggaggtacatggctgcagcgtcaccattgagaggatctatggggttaggataggccaataactgaggcaggaaggactcaaatatattggtaagatctgaaaaaccaaacaaacatgtcacacatgggaaatgcaagttcacctaaaattcacttgcattcagtagtcaagctgcttaccttcttagatattcacacggggatgattctccatacgagtgtgctctattacatgtgacttgtattacacattcatttcaataccaatttaaacattttaattttaatttgaagaacgagataaagatatacctgacattcactttgaaggacaattttcccaattctatttcactctatttatatggctatttcacacagccattttctacagcttacaaaaccccccactctgaaaggtattcagatgctgggtcttaaaagaattgaagacagtttttgtggggtttttttgtttgtttttttttttgagacagagtcttgctctattgcccaggctggagtgcagtggtgcaatcctgactcactgaaacctctgcctccatgttcaagcgattctcctgcctcagcctcccaagtagctggcactacaggcacctgccaccatgcctggctaatttttgtatttttagtagagacggggtttcaccatgttggtcaggatggtctcaaactcctaacctcaagtgacctgccagccttggccttccaaagtgctgggattacaggtgtgaaccactgcgctcagccttgaacacaattttataggacttgacatttaattcaattcttgcaacttctaatggaggtaaatataaccaatttttcaattattctgggtaatgaggataggaatctatatggaccacataagactacaaatattcataagacagataagcaccaatctactgcatttatttatttaaaaaagttttttttttgagagaggatctcactctgttgcccaagttggagtgcataggtgtgatcatacctcactgcaacttcaaactcttgggctcaagccaacctcccagcctcagtcttccaagtaaattggactataggcatgtgccaccatacccagctaatttttttttttttaaatagagacagggtctccttatgctgcccaggctggtcttgaactcctggactcaagagatccttccatcttggcctccccaagtgctgggattatagacgtgacatttattaactcctttcttgccaggcatacacagatgatatctacacacagttagcaaacaacaaacacctgcagttacccagcgttttagaaaagcaggccctgagaacctgggtataacacaacccacacaccccatagctcagatatgctgtaacttccacactctgctcctcagtgaactgcagcacccctgagaaatggaaggacatgagaatgcttccatgtctctgccccactccagctgctttgtcatgttttatataaaacattcctgtttctggagacaatgctgaagtatactaagtagcataaaaaactactcattaatttagtcagctctttcaaccaattttgcttttaacaatgggcgctcctttgcagtattacagatgaatgctttgccaagccacattgcttgagatttgtggttctcagccaagggtgattttgctccccatggaatttggcaatgtctagagacatttttggttgtcatatctaagcggtgctactggcatccggtgggtgaaggccagggaagctgctaaacaccacaatgcacaggacagccccacaacaaaggattatctagaccaaaatgtcagcagtgctgaggttaagaaaccctgatctagataaaagcggtaggcaaacctttttgtaaagggtcaaatacttttaggctttgcaggccacatatggtctctgtcataactactcaaaactcagctctgccactgtaacacaaaagcagccaaagtataggtcaacaaatcgatgtggctgtattcctataaaactacatatacaaaaacaagtacccaaggtctgcccaactttgctctagaaaatcttacctataagaggtggctcttatcactgtaaggttaagaagctgagcagttagagactaatctagagctgtgttactcaaccgaactttctgcagtgataaaaatgttttatatgtgctcacctaaaccaatagccactagccataagtggctactgagcactcaaaatatggccagtgtgaataaggaaattaattttcagtttatttaattctaattaaatttaaataaccacacatggctagtagatcctgtattggacagtgcaggtctagagaatgatgggctagagggtcccatgacagctaccacgtcctgttctcacacaccaggtattgacacagagcagctctgccttacaacaaaagccacagacttggggtgatttcatcagagtctatttcaccttcataaggctgacttcagaacggtcctaaagagccactttatagtaaggttctcatgtaccacgaaagaaatcctgacactcctaatcaaaaaagcaaaacaaaaatcaccttcctatataacccccaaactatctgcagtaagattttcaccaatgttttatctacaatttttttaaaaagggaaacaattattatggtacaaaaccattgaaaactatttgttttcaatgaaaaaaatgcttatacttgaatgctgggtagagaaaggccataaaatggtatgttttctagaattacaactatgtacagtgtgtatgcataagacaaacattttaaaaagctacctcaaggcaatagatgtgtaacttctacttttcacatttcaaatgacatttcttttgcctttaaaaatcaacatttttggctcacacctgtaatcccagcactttggtaggccaaggtgggtggatcacataaggccaggagttcgagaccagcctggccaacatggcaaaaccctgtccctactaaaaaatacaaaaaattagctgggtgtgatggcgcgtgcctgtagtcccagctacttgggaggctgaggcagaattgcttgaacctggggaggtggaggttgcagtgagccaagattgcaccacagtactccagcctgggcaagtgagtggaaccctgtctcaaataaataaataaaataaaaataacattttcctgtaaatatgtcctttctattttggcatatgtttgaaatatccaataaaacatgaaaagtctgaaaatgtttttattttcttatctttatccttgggtgggtgagttattaaggcagtggtagaaaatgccaaaaggtaagcaaattcagttttacaggccagacgcagtggcttacaactgtaatcccaacactttgggaggctgagatgggcagatcacctgaggtcaggagtttgagaccagcttggccaacacggtgaaatcccgtttctactaaaaatacaaaaattagctgggtgtggtggcaggtgcctgtaatcccagctacttgggaggctgaggcaggagaattgcttgaacccaggaggtggagtttgcagtgagcccagactgcgccattgcaccgcagcctgtgcaacaagagcaaaactctatctcaaaaaaacaaaaataaaaacaaaaaacagtagttttacaattgaatgtgatcccatagcagggaaaagttaaacaatagttacattaacagtaatttttttttttttttttttttgagacagagtcttgctgtcaaccaggctggggtgcagtagtgtgatctccactcactgcaagctccgcctcctgggttcacgccattctcctgcctcagtctccccagcagctaggactacaggcacacgccgccacatccagctaatttttttgtatttttagcagagaaggggtttcaccgtgttagccaggatggtctcgatctcctgacctcgtgatctgcccgcctcggcctcccaaagtgctggaattacaggagtgagccactgcgcccggcccattaacagtaatattaacagtaatggcaggttaatgcttacatagtgcttactacaagcaaggaactcttccatggtctgcatatacactcttaatttcactacagtcaatgaggtaggcaccattttacagatggagaaattgaggcacacagagcttaagtatggatcaggaactcaaacctgagctcatccactatgctgcctctgttaatggataaaacacacactgccgctgccgcaaatttcacgaaggcacaagctccccatgtctctgggtcaaaatcgcataccatcgctggcagggaagctaaatccatggatcagagatgatcaccctcctccccaaagaatccctcacaagtgcaaagaagcatgctaagcaaaggacgttcagatgtttctgtggctattcacagagacggtgtgcttgttttcatgcagctccaccgcaggaggtaacccgcagacacctgcacacagcgaacggaaggctcctcctgccatattattattacaggtgctgctcaaaaggattagcagctggatgctattacataacaacgaaaacctttaaaaacaaagcataggttttatgttctgaagtaatgttcagaagtgcttcagggctagagaaatatcacagacaacgtgttataaaactaggagtttagcgtgtcccagaaagagattttataccctttcctactacttttaagtttcctcaagctaccaataaaaggctttgcctatgaatttgttccaaacaaataaaagaacccttaattattggttcttccttcctgtatctaccgtcttcctgcattaacacatttttgatccattttacagaagtgctgagtcacacctgtaaaacagaagagcagaaaaggaaacacatgaggcccagttttgggtgaagatgacaacttcgggaggccaggatgtgatggctctgccatcttaaagcaataaggccttcctgcaagtggctaacacagtgattactcctaagggtgcttctgaaaggagcatctctcaaatgtgcagatgtgcagaaagtcttctttcaagataaatacactggcagagaagactaaaactataaatcaagaataaaataaagatactcatctgtagaaaaataaagaacactttttccctagatttttgttaatgataaaacgataaaaatgtgtcgataataataacgataaaaatgtgtcagttcaaagatctttatctaaaaacattaaccttcaatttttttaaaggaagagagccagatacagttgacctaaacctgtagagtacagtcagccgaccccatttccgcctgtcttaacttttaaaggaagtcccaagattcctgagtatatggtttatgatgagcaaacagctcttacttttgccttagactcaattagaaccaaaatgtggttcattagcactgactcttcagtctgatcttacattaatgttaaaattataacactcatatctcagtttaggcatataatttatattcatatttactatttaaaaacaggctgggcacagtggctcatgcctgtaatcctagcactttgggaggccgaggcaggtggactgcctgaggtcaggagtttcacaccagcctggccaacgtggcaaaaccctgtctctactaaaaatacaaaaaattagccaggcgtggtggtgggcacctgtaatcccagctacttgggaggctgaggcaggagaattgcttgaacctgggaggcagaggttgtagtgagctgagattgtaccactgcactccagcctgggcaatggagtgagactcccaaatcataaacaacttatcatcaaaagtagcatcacttagtctagagcagtggttctgggctaagtctaggtcctgcttgtccatcacaattacctgtggagtttttccaaaaacttgcttagcatcctaaggttgcagcttcatacctaccccagggcttctggtttaggactggatgggatctgtatgtgtgtgatacagacatctgtgtgcaaaatgcacaggaaatactacctggcccatgatcccctatccccaaagaatagacgggaaggaaagggccatttgctcgtaggttcttttttgcaagaaaatgttcacctctaacagctcgactctggtttagtgacattccctgacccttcccactttcttttctgcacactgctgttaccactgttatctctaggcagaggtgtgccaaaccacaggcagtcaaaagcagatctgttctggaggggaactaaagggccactttggaggagaatgggtattagaggatggttagaatcatcacctaacacaatgtggacatctggcagagaaaattccattaggctgaactgtctccagcaaacagaaagctggctcctcagtggtgaacaacagatgaaaaatctaaaagaccacaagtctaatctcaggctttccactgccttgctctttgaccttgggcaggtctcttcctttctacatctcaatttcttcactgcaaaaggagaagtataacattgctattccttacagggaagtaacacacattactaaaagtgactataagatatacttcaaattgcaccagagaactaaactattaatacaaatatgacatcctcaaagggtagacatttcagctacctgtatcccttaaagaatatgtattaattaaaaagagttacactgaaaaaaatgtaccaattcttaaagtaaaattgccctattccaggtgactcacaatgaaatggtgcagggcttgaaggagaaaacacaagaggggatgaatcacacatctcatgttttattcttggctatttatgaaccagtgaccacaagttatttctttttcctctatttcctttgaaataaatggaaaatttcaagctgggcaaggtggttcatgtctgtaatcctagcactttgggaggccaaggcaggaagacggcctgagcccaggagttcaataacagcctgggcaacatagggagatccggtctctacaaaataataataataataataataataataataataataataattgggcatggtggcatgtgcctgtggttccaactactcaggagagtaggtgctcagtagttgccgaggtgagaggattgctcaagtcaggggcaggtggatgggtcgaggctgcagtatgttgtgatgccactgcataccagcctgggtgacaaagcaagaccctctctctaccaccccccactcaaaaaaaaaatgtaatatacactgctttctgcaggttaaaatcctgtggatacccaaaccttgacatgctctgcctcactgggaaccacaattagcacacaggcagtcattttggagacttttacctaaatattcttcatttgtttttcggacttaatactgaaaaatacatgctgtaactcagaaaccaccaccaagtggtgccaagtgccaagaaccatcaaagccattcttccgttctcaatcccacttaccccatcccctttctccttctactacctgtcccccagaagcccaacatcctgttaaaaacaaataacaaaaaacttatcgggaaagacatcagcatcctgcacagcggctcaaattctgtggcatttgcattttaagaattagctttgtacactgttaccccgggaagccgtcatcctataattattattattattattattattattttttgagacggagtctcgctctatctccccaggctggagtctcgctctatctccccaggctggagtgtagtggcacaatctcagctcactggaacctctgccttttgggttcaagcaattctcctgcttcaagctctagagtagctggattacaggtgcacgcccagctaattttttgtatttttagtagagacagcgttttgccatgttggccaggctggtctcgaactcctgatctcagggtgatccatccacctcagactcccaaagtgctgggattacaggcatgagccaccgcgcctggccatcctacaattttaaaggaataagtctactgggtgtggtggcttgtacctgtaatcccagttactcaggaggctaaggagggaggatcactagagcccaggagtttgaagttacagtgagctatgatcacaactactacactccagcctggatgacacagtgagacccagtctctctttttttttttccagagacaagttctatgttgcccaagctagtcccaaactccaaggctcaagtgatcctcttcgccttggcctcccagtgctgggattacaggcgtgagctaccatgcccagctgaggcccagtctctttaaataaaaaagaaagaaagaaaaataagaagtctatgttggtaactaccaaatccatataactggtccttcatatgtctagtcttgtagtcttatcaaactttacatgtctaagattattttcctgaaaacccattcccttcacctaatgaagggagtaggttgactctaacgccctggctctcaggctccaagcctctggaaggaatctggctaggtgttcttcctttcttccatgtactcactcagtttcccagaaatgtctctagtttttcttttatttcccctggcatgtaactatgtcaaaaccaatatatcattccagccctggatcagggcagccatctactaaatggccttaaaggctctatactctcgcctttgtaatcagagaaagtttccttaaaacaatcacttaggtcatttcccacaaacaataagttcctcttgccctcaatcaaaattctgcaacctggagaactgcttgaactcgggaggtggaggctgcggtaagccaagatcacgctgctgcactccagcctggacgacagagcaagactctgtctcaaacaaaaacaaaaaacaaaaaacacatcactatgtaccccatgaatatgtacaatgattatttgccaatcaaaattctgcatcctccagaagcatgctatccaaacttctttcatcatccctctccctctggaggaggactcctggctttccaagccgaaaatcacagggatagtcactactgtctaaggtatttatctgttctgtaattcaataaggaacagggctgacaggaaaggaaagaaaaatcctgttcacacctagaggaaaacatggacaaaaatcacaagtcaattgttgtctagaactgatgattccctctgtgacttacatagatctctttcccctgaacttttggtcattatagttgaaactcctgggaatttcacccaagttattcacatccttgactactagagaaaagcagctgttgacctttcaaaattccattggttgactttaggaactgtattgaattcgtcatgaactgccacgcaagtcatgaattttacaatatgtgcccaaaataaagccaaccatgaaatctcattcattccacaattatttttggtggtggtggtgggtatctactatatgcacaaaaaccaggtagcttttttttttttttttggtaaggcctgaaatagggcaaataaattaagatctccagatttctttaggtacttaataatttggagttaacagattttcctcaagggtgtattagacactataattaatagatctttaccttctactcctttaccagctcctacaaagcagcaatattaataatggttgaatttttaattttatcctgcttgcagtctgtaaacattaaaagacagtgaaattctacaagaaaagaagagtagtcaaaaacctataaagagtcctacactgcacacaactaagcagttgttatttttgaaaaaaacttgcaaacagagggccctaaaagatgacagacagcccctcaaggaaaacttcagtaaaaccaatcggataggcaggcagaattcaaagaaacagttttgagattaaaagtaatattctctaaaataactaatttgagccgggcgcagtggctcacgcctgtaatcccagcactttgggaggctgaggcgggcagatcacttgaagtcaggggttcaagaccaacctggccaacatggtgaaatcctgtctctactaaatatacaaaaattagtcgggtttggtggtgggcgccggtaatcccagctacttgggaggctgaggcaggagaatcgcttgaacccaggaggcagaggttgcagtgagccaagattgcaccactgcactccagcctgagtgacagagcaagactccatctcaaataaaataaaataaaataataaaacaattaatttgaactcaacttcagtgacaaaaagcccatttctccacctgttttgagggcacacaggtggagagctgaagcaacccaccagacttcctgcagtgctgtggctcaggcccaactggccacagggctcacaatgctgcacctagtttactgaaggctaactagctgcaattaagataatataacccgccaccaaatactaaaaggtatattaaagaattcatacaattacttgactgagagggtctcatgtgtggagaaaatatataaaaagtctaagctcagcagattcacatatcttctcatattagcccatggggatctttaaaagataaagtcttaatgaagagggccatgcaggcaacaaaacaaaacaaaataaaaaaacagaaacaggtgaaaacacctccgaaaagaagtgggatgcttaaaaaacacaccaaactcttccctcctcccacctctcaaaaaaggtggctgggtgcagtggcccatgactgtaatcctagcactttgggaggcccaggtgggcagatcacttgagcccaggggttcgagaccagcctggacaacatagtgacacccccatctctagtataaataaaaaattagcctgatgtggtggtgcatgcctgtagtctctgctatttgagaggctgagacaggaggatcacttgagcccagaaggttgaggctgcagtgagccacgctgcactccagcctgggtgacagggcaagaccttgtctcaaaaaaaaagaaaaaaataacaattagtaggaattcaaacactcaaagaatgtttgcaacatacatgataaatacatttaaatctcagtagtagcattttggtttttaagtattcaaagctagaaacaggtgttcctgtgctgtgtgggaaagggcaatatgaaagatgcagggcgctggcctggcgtggtggcacacgcctgtaatcccagtactttgggaggccgaggcaggtggatcatgaggtcaggagttcaagaccagcatggccaagatggtgaaatgctatctctactaaaaccacaaaattagccaggtgcggtggcaggcgcctgtaatcccagctacttgggaggctgaggcaggagaactgcttgaacccaggtggcagaggttacagtgagccgagattgcgccactgcactccagcctgggcgacagagtaagactctgtctcaaaaaagaaagagagagagagagaaagagagagagagggaagggggatggggggagggacagagagagagaaaggagagagagagaaagaaagaaagaagagaaaagagaagagaaaagatagatggacagatggatgcagggtgctgaaactgggaaaaccagccacattctgctcagggccaggctaccaggccaccaaactgaggtgtgtagttacaggacatagactgtttttaaagcattccaaacccgcttaaaaggtaatttcccattcattgcctaattgtagcccctttccccccaacatatttaaacttcagagagttgcagaagaaaataagtgctactgcatagatcacaatgaagaaaacaagctcttgttcatcaaaaacactgctcttgttgcattgtcaatctcaaaacaattctcgtctatttgggtgttttttagaggtaattcatcctcgttcaaaccttataaccctgcttaccttaagagcttgtaagctaaaacatggtaataggatttgttattaaccttccagaaatgagggcagttaatgtgtaattagctagctggatagtcttgctgtcatactaaaactcgctattcaagcttgtaattactagacaataatttagttgttaatatcagaaaagaataacaagaggtaacttcctgcaattacaagccaagtgtccatacgctgggaagactttataactcagtaatcgtaagtgaatgaagataaaacaaatcaaggttacatttacatataatcaagaatgaaacaagccctaaaatcagagcccctacgaaagtagagcatagctgtggctgtctttcagagccataccctggctggctcatgtcccacgatccaaaaagcctggaccaccccatggttttaaagctgaccaccagtgagtgtggtatttttaatgaatgtccactaagttgttcaaagccagcaagactccatttttatgtatataactagttagactcctgagccacatacacctcatctgaagatttccaagcagacagataaagaaggttggttacggagctagctaagcactgttgaagcgcaaatccacaactgagcacatttctttattatgtacaacaggtgacattatcccaatagtactggacagaattgctctacttggcctctatctacaaataatgacatccagctgttccaaaggcaggatgacgtttgtgattcaacatggacagatcaatactgaagttctcaagctgttcaaatagtagttggccaattaatcatccatgaagacacatacatgtatttcttatctgtgtagttacactaaaatgtttaggaaacagcatgcactaatccagcataaagcattattttaagatataccttctgccaaaatctgaattatttgggaagattcacagactatctaactgaaaaggggatgggataagtgttaaatttgtattttaaatttctaaatgcctggtaaaataaattttaggtgcctgtagtcccagctactcgggaggctgaggcaggagaatggcgtgaacccgggaggcggagctcgcagtgaactgagatcgtgccactgcactccagcctgggcgacagagcgagactccgtctcaaaaaaaaaaaaaaatttgtatctcttgcctaatctcaaagtccttgaagtattccttctgttgtagtcaattttatttgcctgttactaactccccagataactctaggggaagacttttcccaaatgttgatttttctctccagcaaaataagagtagaagtatctagtccactggctagcaaccctaagagtgaaaatgtaaactgcccaatttcataagaaaattgtcttccacctcacttctccacaacttttttttttgtttgtttttttgagatggagttttgctcttattgcccaggctggagtgcaatggtgcaatctgggctcactgcaacctccgcctcccgggttcaagcaattctcctgcctcagctgtccgagtagctggaattacaggtatgcgccaccacgcctggctaattttgtatttttaataaagatggggtttctccatgttggttatggctggtctcgaactcccgacctaaggtgatccgcctgccttgtcctcccaaagtgctgggattacaggcatgagccaccgtgcccagcctacaacttaatccatcatataaataatttacgaaggcagtcaaagaatgagtaaaatgaaagctggagagagaaacacatttgcagggatcaagcatgcctggtccagaagggtgggatgagagagagattaaagctgtatcgcagtgaaggcacctgggcccccaggagtgcagggtgataagccaactacagataaaatatattttggagaaaaaaaggaaaactggaaaatagaagagtgcttaaaaagctacctgtggcttaatgaactctcctatcagtccttaaaattaatttgttttgaaatggaaatccagatccccttggctacattttatgtttctcagagcttctgtcactgctgtctggaagagcaggaagggatgcaaaaaaaaagatgctatcatgcaggaagccaaaatcactttggtcatctgctactttctgtttaatgtcataacaataacaatagataacttcatacttgataacttcatactgatggcaagcatcttacaaaattaatccgattcctcactataattagctctcttgtaaggttaaataatacaaaattaaaaattactgggtgagtaaaccacaattataccaattttgaactctgaataaacaaattgcacatacacttggcaaagagaaaacaggataagaacagaagcaatgagtcaactggcttaccagaaatcaatggcggggaagggtgtgaggggacagaggactaaatttactgctaacatgaatgttgtttaatatcaggctatgattaacatacatctgaaatttcaactgtgaattgttgttacgctacaaatatgtatacccacagaacagtacatgtcctggggcaaggtaaatggcaggaaatttcacaatccactccctgctccctcatcgaatctacagcagaggaaagtgttgaaacaagttttaggtgccaggcttagccttttgcttttcagttgaatatttatgttgacacgccaactttctcctattagttatttagtgttagttttttttttttttttttttttggcggggcaggggttggcgggggcagtcctttgaactaagattctctcaggaaccactgcaggaaatgaagtgattcagaactcaccaattatgaactaaccttcaatgccagaggctttaacagtttctaataaaaattcagttcagatctcaagttcagataagtctgaaaaaacacttcaaggtcatctgaacgaacatattctaccagtactttatataattgtatttacctgttcctaaaactttccgtgaaagaaatgttgaattttcttcagaaatagttttgagcaaaatgtcaaaacaattctcccatgctcagtgtacttttgactatactctgaaaatatttcttcttgttttcctgcacttacctgttagtgtgctcacactcctgtattatggaacatgttcagtaactcatacacatgtaacacagaagtctgctttcagttcacttggaccaacgtggtttaactcttgctgcttattaaatgctttgcaagctaatgtaagtacactaacattttataaatgtgatgaaaacttactcatgttggccactttacaaagtagtctatcagtcctcaaatagttaaacatattatccagcaatttcactcctaggtatatacccaagagaaatgcaaacatgtctacacaaatacttgtgcacaaatatttataacactcataatagccaaaagacagcaataacccaaatgtctattatctgacaaataatgtggtttatctacacaatgaaatattattcagccataagaacttccgatacatgcaacacggatcaaccttgaaaacattatgcaaagtgaaaaaaaaaacagtcacaaaagaccacatattatataattacgtttctaagaagtgtccagaaaagacaaatccacagaaacaaaaagcagattcgtggttgcctagggcgaatagttaaagggtacacatttatttttgaggtgatgaaaatgttctaaaattgactgtggtgatggctgcatataactgaatgtattaaaaactactgaattacacactttaaatgggtgatttgcatgtctgtgaattataattcagtgaaactgttatttttttaaaaaacctgttctgagacatgaagtacttgacagtcagcaaacatctttcacaaagcttttctggtcaatggtaaaagctttagcaaaactaaacatcaatttacttcattgtaattggaaccagattgcagtattttgatatgtacatttttaagatgtgaatgtagtttaagaaaacacatcattacatcagatattccaggcagcctgccatgagacatttttaccaaaaaaaccatcttaaaaggaatccatttaatcaagctcggagtgtatgttctttcttgttgcctcaactatatgccatcatctcccctaaaactctcttgttaaacagttctggacatgattaattcactcattaagacaacaaatagtcgaacccttattgtgcaccaggcactgttacagtcacgtgtgcgtgtgcgtgtgtatagagagagagagacgagaacaagacaaagtcctcactcatggtgcttacaatccaaggggataagataaataatatacaaataccagttttagaagcttattgaaaacggggtactagccaggcatggtagtatgcacctatagtcccagctactggggaggctgagatgggaggactgttcgagcctaggagctcaaggctgcagtgagctattatcgcaccactgcattccagcctgggcaacagagtgcaactctgtttctatgtattaaaaaataattttaaaattaaaaaatatatatacaactgggtgctgtgctatggaggggtgtgatttcagatggagtagctgggaaaggaaactgctctgaggaagtaatatgtgagatgagtgaagaaggtgctaaccacacaaagatcaggggggaatatcccaggtagagaaaataatttttgaacggcacaatcaggtggaggcagggattaactgtgttctgctggtgaccaacctttctctgtgattctcatttaccaatctagttcaaggatatctggcaaaagtaacttgcagattgtggctggactaagaagtcttacctacctcagaccactaaaaggtcgtacaagttcaacaagaagcagccatccctggttaagctcagcctcaactgagctttcccttcttttcttgtgcctctcagcaatggttacctgtaccattcattctttcaacccatactggtgaagggcactgtgataagagtcctgggccttacagatgaatcagacacacacccgatagcccttaagataggaaataatctagtagcacaaaaaaataggcataaacaacaaatacacagtagaaagtaaaagtggaccataaaaaaggagctataaaatgtaatggtatccagagattacttccagctggagaatcagcggaagtatacggggtaggagcactggagtaggtagactctatgaagcctgagatttggacatgtggagggaaaaacagatttatttgttgtatccctaattaacttcaaatacacaactgacccttgaacaacatgggtccacacacagtttgaactgcatgggtccattcacatgtggttttcaataaatacagctagccctccatgtcagtgggtttcacagggatgactgtgggacttgagtaagcatgaattttggtatctgcaggtggtctgggaactgatcccctgcagataccaagagatgactgtattttaacatattttcagctccccaaccaggtgataaggaggaaaggcctgatgctctttataactctctgggatattcagcatagcattttgcagagctgggcaattcatttgttgattccctgtaagagatggggtgtcaatttcagcactgaaggtaaggctaaattactcttccttcataaggaggttttggtctttgaaaagatgatcccctaaaacctcttactatatcattgctctctcatttcagagggacattcctaagtagttttagttttttccaaaaccaaaatatgtatatattatgtgctaatacatacatataaaatgtttgcacatgtattcatgtgtgtgcgcatgtactcatgtgtgtgcacatgtatcactataccttaagtttggaatctcaaaaaatcattttaaacttccacagctaaactgatatatttgtacttaagagaaaacattttttccactgatcaaactttcccagtcggtccctcaaaaatcccttcccattaccaacaaaacatcttaaaccagaaaagaaaagccaaacaacatttttttaggcaatgtctcaacatctccaaaaaatattccatggccaaactcaccatagagagctgtccaagtttgattaattacatctagacacacagttcctgacctgaaacagatggaaagaatggcatgtttttaaaaattagaaagttagttgcatgtatctggcaactaatttttacttatcaagagaaatacttctaatagatctgtgaaaaaaagaatcccaattggggaaaagtatgatgaggaacagaatagtaccaggtcttgaagtgtcaccttacagactgaaaggggaaaatagtaactatgcaatggagaaaccagacaacacctgaaccaggtgctgagaacacaaggggcagacagaccttgtgtgtctctgaatgtgataccccaagaaggacaccatcttactttgtagttttctggccttaagtgtgttcatgccctgaatctaatgatcaggaaacatcagacaaacacaaattgaggaacaatctataaaataactggtctatgttattttaaaaagtgaattttataaaagataaaggcaggctgaggaactaatcctgattaaagcagtttaaagaaacatgacaactaaatgtaatgtgtgattctagactggatcctttattgaaagaaaaaagtgctaaaaagtaagttactggaatatggcagtagattaaataagtattgcattaacgttaaattcctgaatctgacaactatatactgtggatagataagagaatatccttgttaggataactgatacaataaaatattaatattaaaggactaaggggcatgatgtatgtatatatacaacctactcacacagagtgcagaaaaacctgttaggtatgtttgtgagagacagtaaaacttagtgccatgacaaattaaaattgcatcccaaacaataatatattctaaacagcactagaagtataaaacaggatatgctggaatattttaaagtatcattaataaaatattagaaggaaagaaggggataaataagattcattaactgaaatgaaactatagtcattttgccttactatctatcaagaattgagaaaatattataagatctgaaaatagtctatctgtaggctgaaaacagatctctgaactgtgtctacaaaaagagaagtgagatgtggaatattactactgtttgctgggtaacaagaaaaatgaaggacccagtcacgacaatggaaaaaaataagtggtacaacagcagaatgtgaactaagtgattgagaacctcatatcctttggattctatcatttacatgaccattcatacagtcctacctcctgataaggtccaaaaagataaccgaggctttttataacacagagaaacactaatcatgagcagttgctgctaaaattgaaacattttaaaatagttacttacgcttcatcaatgttgggatggaaaattttattcatgaatcctgtaaaaagagatgttaattagcagcaaaaagtatccagagaacaataaaagtatttcagtactggaaacaatttcagtattgggaaaaggtgataatacttataaatcactactttcaaccttagatctttcattactgataaacattatattctcctgatagctccaattatttggaatacatcagcattctattaacaaatgagcaaactgggagaaatgcagcttcttatacaaaacaatcattaaagcaactgttttctgagctatgaaggtactgctcaaagataaattatactactaaatggttcatagccagtgtcatgataaaagttaagaaacttcactctcccagaagttttgttgttcaagctctaaatctggaggttctgcatttcaacttctccttctgacgctcacttactggtatcacttggctgcactgtgcacggaacatgaatgaaactgttgaaatgctaaaggaataccacttcaaaccacaaaggatttcctaaaagcagtgaccaaaatatttcctttaacattagtctactcattcagggaaacccagttttgattaaaattggggcaaccaagcaaggagttaaaaaaaatactctaagttggctatatctgttggaggtttaagtttttaaaatttttcctagcaaaccaagtacacactttaatagctatatggccatttgaacttcaaggagaaattaataaaaccagttattcagtcagtcagtatatatgcaaatggcaatattctaaagcagagatccattgtcaaaggtgtcattttgtcatccttatcacttcatttccttttaggactcattctgttccacactttcaatatctgaagttccttattaaggtgagtatcaccaccactatctccgacccccatcctccatcacccccatccccacagtctctctctctcatattcattcagaacatatttggtcagcacctacaccgcaggcattgtgcttggatagggtataaaaataagacagttcactattcttgaggaggtcactgtggcagtgggacaagagacaccaataaatacctgcaatctgaataaagtattgatacagtaggcggagtaaaatgggaagagtcaggaaagatgcagagaaatggcactggaggaggagcctcaagtgaggcgctacagagattgtctccaaaaacctgagaaacttcccctgaagtagaaaacaggggataagaataccaagtccaagtagtccagtcttagaccactctagtcactcacacttttaacttttgtttttaaatgctctgtgttgaaacagcataatgttctatctactacaatcaagagggcctatgtgatgtttaagttactctgatgaaaaaaaatctttgtgtccaatattaatttttcattaaggaaattaaagatgtttcaaagtctagatttaagaagcatgtggtttatgaagacattttaataatgggaaatgttcatgtcttggtattaagaggagaaaaattagggtaaaaaacattctacattaactttagaaaaatactaatacacatgtcccagatgccccatgagagtatttgttgcaatattatttataaaagccaacagccaaattcaaccctgtcaatgggatagggttggataaaggggagtacatccatctacctgagtcctatacagccaagggtaatgaagtagatccatgtgtatcaacttgtatacatctaaagctgagttttgttttttttttttaagttgcaggatgttatatttacaggctgaggttatttaaataaactaaaacaaacaactaccaattctccatggtaacaagtataggaaaactgtactgaaccaacatataccaaatttgcaaaagtaattgtttcagttagggcacagggccagggtcatgataggaaaagggaacagaagaggaaacagtggttaaaaatgactttatctggccaggcacggtggctcatgcatgtaatcccagcactttgggaggccaaggtgggtggatcacctgaggtcaggagttcaagaccagcctggccaacatggtgaaaccctgtctctagtaaaaagaaataaaaaattagctgagtgtggtggcgtgtgcctgtagtcccagctactcgggagaccgaggtagagaatcacttgaacccaggaggcggagcttgcagtgagccaagatcacgccactgcactccagcctgggtgacggagtgagactgtctttaaaaaaaaaaaaagactttaacactattaatatattccttttaaaaagggacaatgtgcttctatattatttgctctgtttaaaacatatgcacataaataagaaactgaaagtaagtacaaatgttaacagtgtagaattcttagtggtggtagtattttctccgctgcacttttcaaatctcatcaccacctcaccacacctgaaccagaactaggatcacagcaatgggaaaaggctagaagaaaacaggtgtggatggttgtcatgtttgcaagattctcccattatttctacttgcacttttggctctctgacatttctacaatgtgtaattttaatagttgagcttaaaaaaactccgaaataaaaagttatcatagtatcagctggccacagtggctctcgcccgtaatcccaacactttgggatgctaagacggacggattacttgatgtcaggagtttgagaccagcctggccaacatggtgaaaccccatctgtaacgaaaatacaaaaattagccgggcatgtggcgcccacctgtagtcccagctactcaggaggctgaggcaggagaattgcttgaacctgggaggtggctgcagtgagccgagatcatgccactgcactccagcctggaagccagagctagactccgtttccaaaaaaagttatacatagtatcaaacattctaaaatagactgaattacacaagcattaactagtgctgaactattttaagaaaaagccagtaaaaccaaccattttatttgaaatctcgtatcttaacactcttgttcaaataatacaaattcattaccctccccctaaaatcagaggaacctcaggttataaggtacgtggtcctcaagatcagttatatataggagtatgctgctatcactactgcagggaagctttctgatgagtggggaacaatgctgagccactatgtggtttaatgcaagagaatggtcctactatatgaaaaatattgcctgaagctactattaagaattaaaaatacgttcttgatacttaaaatcctgcctctgtgagaactctcaaaactaacacctaatgaagcaacgtctatggcaaaggttcccaatgctggctacagatgagaagcactgggaagttttcatttaaactaaaaccaatactcaaagacacaggacttaaggggaaatacctgtaaggaaaggtctttagaaaaaataagtcctacattagaaggtcaccagcattatggagaaaaacacagcaaaggaggaaaacagaaatggaaaggttggggcggggtggcaattttaaatgagatggtcaggaagggacttcctgagaaagtgacttgctttgaaggaggtgaaagaggagccacctggtaccaagaggagaggagaaggtcactatagagggaacagccaagtgcaaagcacattaggagcttgcctgatgctctgaagttttttcctgaaactgaagggatttgaaaaaggggcagaaaatgagaagtgatgtcacagaggtgatcagcatttggggcccttttaaggacactggcttttattcaagggagatgggggggccactgagactagtgcctgaacagtgacatattcacatacttggcttaacaaatggcttgtgtcctaaaataggctagttggggaacagctcaatcagctcacagcacctgagtgctggggaatggcagatctcaagcaaaacaaaatgggaatcctacagggcattatgcttcaacgatctgaggccacggggcatttaaaggtgttaagtcaagcaaataactatggtaagctttaaatgtttatcaaaacgtctctgaaagactaaggtgcctccctcattggacatgacctggagagcacacttggaattaacagtgtctatacagttttcaattaaatctagatttggcttagttgagtacaggaataaataacagaaccaaaaaggacttggtaaacatacgctttagtaataaatggtttggagctcagtctccagtgcccctgctaagtacagaacaccatctgagcactagtacagagggcagaatcacaccacaaagcaaagtactaaacagggacatgggttctagcctcaactaatcaactgcaggccctgggcaagtcacttcaccttgtggggtctgtttctttacctacgaagacaaatagttgaactatatgatctcccaaatctccactcttactctatttctgaaggccctatcagctctaaaaatctagcatttaataacaatggcaagcactctgagaacagaggaattatggggaaatatccaagagttaagtccttaaaggaaattaattctgtaaggcagcatttttaggtacagaaattttctagagaatacaaaaccaccaacatgataaaataccataaagagccacaaaacaaaccctctgactcttctaaagtaggcagaaacagtttataaccttgcctttgagggatgaacacaaccagaccaactctatcaagaaactttctactttctaaactaaaatgatctcttccaatactaggtgtttttttttttttttgagataaggtcacttcgtcacccaggcaggagtgtggtggtgcagcaccttgctcactgcaacctccgcctcctgggttcaagagattctcctgcctcagcctcccaagtagctgggattaccacaaccagctaatttttgtattttttcgtagagatagggtttcaccatgttggccaggctggtcttgaactcctgacctcaagtgatccacccacctcagcctccaaaagtgtggggaattacaggcgtgagccactgcacctggccctcaggcttaattgttagaaaaatatccaaagcaaatacatggaaaaaagcatatctccttgacatttgttcttagacaagctgtgggcagtgtttctggcaaagccatttacattctggataatgatgccaacaatggaactcctggacaaggaggggggagacagagaaagaacgggccagaaattcggaaaaggaatgttctcaggactgtgttgagttggccctggcatgttctccttccttttggcaatgctatcatcacattaatgaatatgtctgcaacaagggaattttcccaacacttgtttccattagaccaggaactattttcaagatattttaagagaacatattttgaaaactgcttttatggcaacataagtagaagtagcaggttatttttaatcttcatgatttaagattttattcactaccaggcattttctttttcttttctttctttttttttttttttgagacagaatctcactctatcactcaggctggagtgcagtggcgatctcggctcactgcagcctccacctcacgggttcaagctattctcctgcctcagcctctcaagtagctgggactacaggtgcccaccaccacacccagctaatttttttgtatttttagtagagatggggtttcaccatgttagccaggatcgtcttgatctcctgacctcgtgatccacccacctcagcctaccaaagtgctgggattacaggagtgagccaccgtgcccggccactaccagacattttctaacaacatatttcagtgatttgaccagattaaaatcagaactccttaagttttttggacagttattctctggcgtagttctagcactcgttaaaggggatggggaggatcgtacaacaggaataaatgtccagctaaaatgcttacccttctctgtcctgcgtcttttagcagaagggaattaggtaatttataattctggagaaggaatccaaatcacacttaatgtaaaactattattatatatcttaaaaaataaaaagtacagattacaacagaaaaatatgccttgcttttgcttgttccactccaatactcaactgctctagaataacaaatctcatgacccataggctaataggcagtgaaaataaataacattgtgctaagtcatgctgaaaaactggtttttatttcagcctctgtgtccagtcccaggaaggggtctatacagagttgcacacacttctgagtaacttctgacattggggtcaatatgtaaataaatgaggccaagcttcacctatttttccatctttgttccctttatttgagaggatattaatgatcaaatttgtgggtagatgaaatactttgggccaatcaccagaaatttcacctgtcagaattatcttgacaaaaggagaggttagacaaacgacttgtgaatcaaggtaaatccaccctacggtaaacgggtgaagatcaccaaaggccaaaacagcagctacatcccagggataaaataagcctaggctaaggtggttcagacagctgtggctgatgcaattgcattataagcttatgaattcctgtgagaaaacagttaagtgaatacattaagtcattctgatcgtctatcttcagaacaactgcccacataaagtagactgttcacaaccaaactgattaattctattttttcagtaggtataattgtttaaaatattcttattaaagactgaatctcatcttcccttgcagtatctcagactataaattatttaagggtaataacttggatctctgttcctagcacacagggtgaccagagtaggggtgttccaattgagtaagggtgggggggtgctgccagctccactagtgacagacattggccagctatgtgcaggagtccacaatctgatagattttcatctaacctcagacagccaggccccacctgaggcagcctgtgcccgggtagaaatctcttcagaaatctgagcctttcctactcaggagagatggacctgggcctgtctcttcttgggtgaggaaccaggcaaggagctcactctcaatgccctgtgtcatgggaacttctgaactgatcctgtgtgtgttcaggagatctaaactcaacaaggggtcctcttttctgtttcttcctttctctctggtaatatagagtctgaggaatgggctagatggataagaaaaggtcatttataactaagaaaaggtgaagtgttatccttcaatagcataacccttctaccaacctagtggattatcaaaacctctggcctactttcctttggtttcatttttgggagactaacttctgttttgttttcatagtttatctttcgatcgctgggtcgttcatataaccacactgttgggttcaggcagtacttattttcatggtcagagacaatacagtacagaatacattggacttgaactcacaagacccaactacaattctctaccactcttagagttgtagttaaaagatcaggctccaaaagataaatgtttgaggtgacagatatcccaattaccctgttttgatcattacgtattgcatatatgtaccaaaatagcacatgtaccccaaaaatgtgtgtaactgatgtaacaatacattttttaaaaaggaccaggctccagtcagaatgcctaaatgccactgtgtgagcctctggggcaatctacttcatctctttgcctttctgttcccttattcctaaaactaggttaaataatggtatctacacatcattaatcgtgaagattaaatgagttaatatatgtaaagcatttgaacagtaactggcatacagtaagcatgcagtaatgttagaattagcttaataagttaaatgaacaagtaatttcatcttactgtcttcatcctaaaactgattaatatttaccctatgtgtccatctcttaatgctcttacaagtgtgaagaacatgagaggatattatgatttacatatgtttcccataactctgtcacactagaaatggaaaatacaattataatttttatttttaatatttattatttgtgtgacacagccccaggaggtcctgagaacatgtgccccatatttattattaagaagaccatcctacacatgcacacgtatgtttattgcggcactattcacaatagcaaagacttggaaccaacccaaatgtccaacaatgatagactggattaagaaaatgtggcacatatacaccatggaatactatgcagccataaaaaatgatgagttcatatcctttgtagggacatggatgaaattggaaaccatcattctcagtaaactatcgcaagaacaaaaaaccaaacaccgcatattctcactcataggtgggaattgaacaatgagatcacatggacacaggaaggggaatatcacactctggggactgtggtggggtcgggggaggggggagggatagcattgggagatatacctaatgctagatgacacattagtgggtgcagcgcaccagcatggcacatgtatacatatgtaactaacctgcacaatgtgcacatgtaccctaaaacttagagtataataaaaaaaaaaaaaaaaaagaaaaccaaaaaaaaaaaaaaaaaagaagaccatcctttcttgatgtgcaagcaaaaattagattaaaaaaaaaaaacatcctgactgcatttggtatagttaaaaaacaagcacacacacactaaactggaagccagaagatggactctgcaactagtgcgtagtcatacatctcagcctcatttttttccatccttaaaatcaggcaaattggatgtcataatctctaaacttccactaacaacacagttttcaccaacaccaggaatataagcaaatctcaaactgtgaacaggtttctaaaaagaactaagacattgcttttgttgttttcaaaagaatttcagtttaaagaaaaaggaagccaaaaatacttgttttcattatgacaccaaatcctaaagggaaagaaatagatttaatgccaaaaagatgtcagaataaccagctcaaaagctagaggtcacccaatacagagtaggaactaacctaggcagcaagtgtgatggaagttttaaatagcaaatgaaaagattatataataatgagctgtcaaaggcagaattaaaactggcataagtcaacttcaagaaagaaatggactgtaatcccagcactttgggaggccgaggcgggtggatcatgaggtcaggagatcgagaccatcctggctaacaaggtgaaaccccgtctctactaaaaatacaaaaaattagccaggcgcggtggcgggcgcctgtagtcccagctactcgggaggctgaggcaggagaatggcgtgaacccgggaagcggagcttgcagtgagccgagattgcgccactgcagtccgcagtccggcctgggcgacagagcgagactccgtctcaaaaaaaaaaaaaaaaaaaaaaaaaagaaagaaatggacaagtcctctgatagtaacaagcatatgcaaaagcagggttatccttagaggtggcagcctggggaatggggtgggaaagctaactgtactatttttactctggctaataacaagatgaaggtaaatgaatttagacattacagcctgctcacagcaggtttcacattaaaagggcccatttgaccactggcttctctcactgagaacttcagcacctggcttggcccccaagttgctctctgccccaactcctgtcatttttggtgacaatatagaccatactcctgacacccgggtctctctctctctctttttttttttttttttggagacagagtttcattcttgttgcccaggctggagtgcaatggcgcgatctcggctcactgcaacttctgcctccggggttcaagtgattctcctgcctcagtctcctgagtagctgggattacaggcatgtgccaccatgcccagctaattttgtatttttagtatagagacggggtttctctatgttggtcaggctggtcttgaactcctaacctcaggtgatccgcctgcctcggcctcccaaagtgctgggattacagacgtgagccaccgtgcccggcttgtttcttaagcttctcctcagtgaccttctattccattccacttcatgctccccaggacataccctgacctttgtcattccctccacaattacatatttacctccacaatcacaaatttagacatctcctatcctaccaatcccctgtccttgccaaaagcttcccaccccaggaatcattaattctttcacctgttaactgtaatccacagattctcccattttcttcccaactaccagccctcttatcttcactggcttcttactcagcttaagatttaagagccatcaccatcctcactctcaagcaatcctctgcaaatcccctgtcctctcccctccaaaatgcccatctagcaaagctaccacaggaagcatcattcacatttgctcaacttggacttgagggtaccagtaggtaggcattcattcactcacacgaatattcttctgcagaaagggcactgtatcaggccctgagtagtgagtatttgggaggacaggggtggtggtagcaaaacagacccaggggctgccttcatggagttcacatctactgagctggcagggaggagagacataagtaaacaaatatataccagtttatctaaacatgctcaacagcctttcttggactcagcatcacctacaatcttcccttcccctttctctagtgggtcgctcccccagtctcccatgactgttacattttaccacaatcctgcaaatctactttctttctctccctttgttcccctaactctctcctctagttctttcactaaatagccttgtcccttttctttgagaagatgaaagccaattggcaggattcttcattttccataaaaatttctaaactcctccctgcacacatactctttctccctgcctcaacagcttgcacacatgttcccctcttctcaaacaccaggcctctgggttctgatcctgctccctccttccttctcgatggtggtgctcctgcaattctcttcccaactccagcatcaccaagctctcccttttctaaacatctctctacaataagcactttaaaatccttcagaatcttccatttaaaaattaaaaacaggccaggcatggtggctcacacctgctgtcccagcacattgggaggccaatgtgggcagatcgcttgagtataggagttcaagaccagccagagcaacatggtgaaacccatggctacaaaaaatgcaaaaaaattagccaagcgtggtggcccatgcctggagtccaggaggtccaagctgcagtgagccacgattatgccactgcagtccagcttggatgatttccttaatggagccacatgtcttcacagcggtgtatgtctagaacaaagtttcttgaccttggcagccttgtccaagccaccagcatctccggctacaaaagcttttataactgtgcttctatcccgtcactgtgtcttgccccacagcagtagaatgatcattaaaaaaacaaaatcagacctttcactcccctgctgaaaactatgtaatctttctattacatttaaaatgaaagtcgagcctttaacctggcctacaaagcggtctgtgaactcaaccctgcctgccacttggcccgtgtgtcacacacctcacattttacccagttttccaggctggggcctttgtactcaaaatttcttctgcctggaaagctcttacccctgattttggaggatcagggctggtttttgttttgttttgtttttaatctttttaagtctcagcttaaatttactttgtcagacccttcctgaatatctgatccaaggtacctattctatccattaattctctgcataaagctatcagaagttttaaattttgctttatcttcgcactccaaaagaacataaagtattaagagagcaatttgttcacttctgtatctacagcacccagaataacgcccagctcgcagtaggtatccaataactttgtgaaactgattggaaggatgatgtatgccacagccaaagcctcagctgccagacataatttttgaaaaatgttattttcagaacaccagtaaaagagcttttaacaatggcttatattctcatagcattatctctatttatttttttacaaaaccttccttacttactagaaccttgtttctctctactggaattcaaaagatacttatcattggccaggcacgttggctcacgcctgtaatcccagcactttgggaggccaaggcaggcagatcacctgaggtcaggagttcgacaccagcctgggcaacatggtgaaaccccatctctcctacaatacaaaaattagcttggcgtgttggcacatgcctgtaatcccagctattcgggagactgaggcaggagaatcacttgaacccggggggcagaggttgcagtaagctgagattgtgccattgcactccagcctgcacaacagaacaagactctgtatcaaaaaaaaaaaaaaaagatatagatcactacagagtagccattatgtaactgtttgggacaggactaaagtcataaccacggttattagagaagtacacaggtgatctgaatggaattttgcctccccagccccaaaattcattttatttgagacggagtctcactcttgtcgcccaggctggagtgtagcagcgccatctcagctcactgcaacctctgcctcctgggttcaagtaattctccttcctccgtctctcgagtagctgggattacaggcacgcgccaccatgcccggctactttttatatatatatatttttagtagacacggggtttcaccatattggtgaggctggtctcgaactcctggcctcaagtgaacctcctgcctcggcctcccaacgtgctggtattacgggcatgagtcatcgtgcccagtcacagaattcattttatttgtgaaaatacagtggtacaagtaggcctttgttaaatgactaacctgaaacctcttgtgaatgacaaactcctctctactgcaaatactggcccatccctgcttaaatactgctcaatgaagttactcatgctagttcttgagggagtaactctagaatgattccatctaggaagacataagataaaatggtaagtattctaagttctataggtagtttagtcatgccatattataaacctccactccaaaaatagtgtgaggtcatttctggccagagtgaaataaaaaatgtataatgcctgaacagtctattattctgacaatgaaaaagattaatgcagttccctttatcacttgcatgagtaaaaaaatatatatatatattggctgggcgcggtggctcacgcctgtaatctcagcactgtgggaggccaaggtgggtggatcacctgaggtcaggcatttaagaccagcctggccaacatggtgaaaccccgtctctactaaaaaacacaaaaattagcagggcatgatggagcatgcctgtaatcccagctactcaggaggctgaggcaggagaattgcttgaacccgggaggcagaggttgcagttagctgcaatggtgctgccactgcactctggcctaggtgacagagcaacactccgtctcaaaaaaaaaaaaaaaaaaaaaaaaaaagaattatggcacactggttatcagagtatatgccagactgggagatttaagaggaactctgacaggctgtccagtctagtggaacagggcaacctaaaccatcctgatagtttgacccaattttaaaggccattaatatagctcagagttttttttttttttttgagacaagagtctcgctctgttgcccaggctggagtgccgtggcgcgatcttggctcatgcaagctccgcctcccgggttcacgccattctcctgccttagcctcccaagtagctgggaatacaggcgcccgccaccatgcccagctaattttttgtattttttagtagagacagcatttcactgtgttagccaggatggtctcgatctcctgacctcgtgatccacccgcctcagcctcccaaagtgctgggattacaggcatgagccaccacgcccagccagctcagagtattttaactattgtattgcccatgactttttcattttgtctccatttactcaaatgggtttggcaagttcttgcttcatgccactaacatcaaattcttttttttttttttttttttaatttcttgagaccggtttcactctgtcacccaggctggagtgcagtgatgctatctcagcacactgcaacctctgcctcctgggctcaagtgattctcccacctcagcctcccgagtagctggaactaaaggtatacaccaccatgcccagctaatttttgtatttttttttttagagatggggtttctccatattgctcagggtggtctcaaaccccttgtctccagtgatgtgcccacttcggcctccccaaaatgctgggattacaggatgagccactgcgctcggcctcacatcaagttctatggcagcacgagcttgctggttttgtacctgaccattctaccaacattcagcaaaccattcagcagtccctccagaatcctgttctcaaccatttctcttaccttcccagctttggtatcatcaaattgcaacccagaggcaatgcatacagcctgctcctagtagagggtcctcctcactgaaaatatgtagatatagatcggtagcatttcacaaattggtttctaaacttgttacctgtaccttataacacagttttctaatttttaagaagtataaatgatgacagggttcctaggctgctcttaaagttatttacaaaagattctaaaatattctatagttctatctgaaattaggatacaattctgttaatagtagccaataatcatttaaatgtaagataaaatgacatcttaattttatctggaatgctagtgtttaagtaaagtagatatgatatgaaggagaatataatagatccagaagagaacttctggatgttgcaagatctttagtggctataagccctgaatttaattttttttatatatataattttttttttttttttgagacagagtctcgctctgttgcccaggctggagtgcagtggcacgatcttggctccctgcaggctacgcctcctaggttcacgccattctcctgcctcagcctcctgagtagctgggactacaggtgcccgccaccacgcccagctaattttttgtatttttagtagagacggggtttcactgtgttagccaggatggtctcaatctcctgaggtcatgatccacccgcctcggcctcccaaagtgttgggattactggcgtgagccaccacacccggccctgtatcttttattagaagacttttatattttttttcccttggcttaggcttatcaaaagtatccccattatgattattagctctaaagaggggcatttttcagttcatatgaagagaaaaatgcaacaacggaagggggaagtggaagagtcaggcagaaaagaaaaaggtgagaagtacttgaggtaaccacccaagagaagagaaaaagggggaagaaagaagtgaagaaagttgcgcgtaaagacagtatctgagatggactaaactctaaactctaagcagaaaacaaaggaaggaaaacagtgtgtgcacttatacacacacataattaaaatttaaaggaaaaaagaagggaggctgctgggaaacacgtgggttaggcaggtcctgagcaagctaccacagggaattctggccaagcctgatggctttctagagcaaaagacagcaaagtgtagactcagacaatgatacagacaggacagtcaaaagacatacatttgcaatatgattaaaaatatttacttttataataaaagcaaacattgtagactatttggaaattacagaaaagtatgtttttagtctcctttaactgaacagctatggataacatcaatagtttggcattcaaatgtgaaatgtataggaaaaaattagagttgtactatataaaaaacattttcctgtgtgtcccttcaaagaggtgttaaaacatgactaatgggtaaaacattttatccactaagatgcactatcacttagctactttatcaccgactgggtcatttaggttgcttctgacttttaagtattataacactaaaatttacgtattcttttgacagtgcacatttctaaatatttctttagataatttttaactttttaaataaaattatttgaaggatataaaatatttaccaagcaatacatagtggtagactggctgtatcataataccttttctaacactgttttatctgccagtttgacaaatcatatactgtactttcgttttaatctgcattcttttggattagacataaaaccattttgtatcctctgcttatttttttttattaaaaattactctgtattaccctcttctatgagatcattcatctttatttcacccacactgtaactgcaagtctgtttggtgaaagctttcacttaacagctgagcacaagtatcaaaggctaaaaactgtgaacctcgagaagtgtgagctatggcagtctctgcagcaatttctttgcataaaacaaaatcttcatgaactggggattacttggggttctgaatgagtatctctaaagtcctcatgcacacctcaacaactctgaagcttttgtgaagacaatctctcttgtagaaacttatgtcttccttacgctctctcttctaaattgaggtgctgactcacacctctcctaaaaaacaatggaaccatgccattaagtacacgtagtattttatttacattcttcttctctcctaaccagtaaagatcttctgtagccttcgtcatgtccagcaggatgccaggtaccccgagttttaatacactggtcatatcaaacatgcagaatctgtttaattctagtatctcattttctagcagagaaaacaatgggtcagctgcatatctctctcatggtcaaggagaaccagggccagaacttctctaccctgataaccagtccactgaccaatcacactctcctaactcctacacagtaacacccagcagtattgctaagcactctaggaactaatgtttctgaatgaaaaatatgaaagtctgaattttcaagtaaatcagaaaaagattcaaatatgattcatctcaaagcagtctctctggaaaattatgcaaatattcagcgatgttatagttgattaaaggagttttatatcttttactcttttcaaagtgcctagagggccggttttataccccaattgatattactcgtttttccattcatcttattctttgggcttaaatgactgttagccatttcaaaaattcacatccagcttcaaagcatcaagatttgccatcacttatgatactgaaacagaagtaaaattccaaaaaaaagagctcaaagtgtttgaaacaataatggcatcataagaataagttcataacctcccaaggtgtctacctatattccttttctttccaaaaagtagctatgccactatttcgaatacccactcatttatagatgcaaattgttttaaagggacatctcatgcaatcatgtaactactgacagccctctaaaactatatttggagagtgtcccaaagataagcatatcacattatattgaatatatatatttaaatattcagagagaaatgtcttaaagagcatattccagaatgtaaataatgacaccctttaagggataagattatgagacattttgatttttctttactttggcttacagattttcttacattgctctaatggatatgggtcatttatacaattaaaatacacatccatacacaaacacacaaaatagaacaaagtacatagacactgcaaaattccaagagccaagcattaaagatgtttgatctaaatttgcacagctgattgtttaaaagctcaaaatttggctcaggaagaacactacacctacccagatacaacaggggcaagatttaaaaagaatgttgagattgggttgatcttacctcctcgcccttctgtataattttacaactatctacacaactcaaaaaggaatccttgccttttctaagtgagccacaacctttctgaatgcttaaagcacatctcaacagtaattacactgttgatgacctgaaaatgggtcaccccgcacaactgattgaaactctcttatgcaaccttcctctagaggaaacaagaacagcttgtacaaatatttcagctaaatctactttccaaacagaagatgatacacatttgtaggcattatcaagtcctgaaagcacacagaaaggcaaaagaaacaattatgaagaagttaaattagcttagtcatttgtcccaaccaaatttcatattgcatcattaatttaagaaagcgtggaggctttttgtgtcattagttaataaacaagcaatgcctaaagtttagacattattacctagaaagttatgatgagataatcatattatctagaaaaaatacattaaggtctgagaaataacatttctacaggatatgaaattgcatttctataagttcactcttagtttcaacaagctctattgtttcctttctgactaggaatgtggggttaacaaaactagacttagcatgccagtttttagcctttaggtaaacaggtatttatgaaatgtatctgaatgaacttgcatggacttctataaaggctttaaagtcctatcactaaccaacataagagttttaaatggctgagtagacagaaacaccctaaagttagaagatgaataaactggggacagggaaccacaacacaacagaaaagccctctcaaaaggagaaggtgtacaggcgtatacgtttctacacctatacaggtgctaagtcagatgtgctcgggggctgtctcaaaggctcaacacctcacagctccactcccactttaccattcacaacgctgaaacttagaggcccctatagcaagaaagaaatttctgattcaactggttaggagtgggggtgtagtggggagtggtctagactccaggatatcgggcattacttcttaagacagcccacagcagccaggcgcaatggctcacgcctgtaattccagcactttgggaggccgaggctggcggatcacgaggtcaggagatcaagaccatcctggctaacacagtggaaccccgtctctactaaaaatacaaaaaattagccgggtgtggtggcaggcacctgtagtgccagctactcgggaggctgaggcagaagaatggcgtgaacccaggaggcggaccttgcagtgagtcgagatcgtgccactgcactccagcctgggcgacagagtgagactccgtctcaaaaaaaaaaaaaaaaaaaaaaagcccacagcagtagcaaaatgtttgaactctggcaattctgaacatgaggcttagtctgattctcagagaatgctcaatatattacaattttattgttcttacttaaaattgttcaatattttataatattttagacatgtataaagtgaagcaaaaaaaaaaaaagctggcttaaattaactaaattactaccattctacagtctccaaatatttaaaggtgtccaccttcaatcagatagatctgtcactgagtgcctcaatgggggtgacaggtaaataacatcacccattaaggtaaaaggagatgaaggtgaggagaaagtacctctttgtacaaccccactgaggtttctattctttcttctgctgtttagggggctaaagagactggaggtgggaagactgcaaagggtcatttaattgtaaggtacccagagttggagtgaacaaaaaagcaaagtaggatctagggagaatttctgaaaatgataggattaaaacacatactatgtaacattcattcttgcaatctggcattcaaaattagacttaagatatgtttattattttcctgctaacagcttaaagaacagtggggccttaaagctggtttaatctgacaccaaaagacaaaaatctaaagtaatggtcattataattatgcaaagagtatatttaaacgtcttctaacacactatagaagttccccccaaaagtcactgattaattaaccaaagccaaaaaaggaaaaattcaattagacagccatttctggcattaattacctcccctgaaatgtaagatttttcccccttagatttcaaaactctctaaggagaaaaaccaagtagtaacatacctatagatggagatttgaaagggtatttatcaggtaggtccactctaactttccatactccgccttcatatggtgctgaaataaaagtaaaaatgttcatcagaactacatctccaaattagaaaataaatctgagtgtaaattaaacattatcccctaatcttctgaaaaccttccaaattaattccttcaagagtcagggacctactacaatcaataggtgtaccacgttcagattaagatacttttcttggaaagatccagagttaaaaaataagcagattcattctgcaatttacttgattcttcaaaagtactaaacactattcaattatttggtaagtaatagccatgttactttccctcctatctcaataaaccccatattcatcccccctccaaggccaaaaagaaaacaacaaaaaacatttcctggaaaccattcacgtggccatccataacaaaacccagaatttacaattcatgtctagtactgtcacatagagataaagagaaaactacagtcagccctctatatctgcaggttccacacccctggattcaaccaaccacagatcaaaaatattagagaaaaaaatccaaacaataataaataacaatacaattaaaaataacacaaaaaaaataccaaaaaggacaagtgcggtggggctcatgcctgtaatcccagcactttgggaggctgaggcgggtggatcacctgaggtcaggagtgcgagaccagcctggccaacatggtgaaaccctgtctctactaaaatacagaaatgagctgggcgtggtggcaggcacctatagtcccagctacttcgaaggctgaggcagaagaattgcttgaacccaggaagtggaggttacggtaagccacaatcgtgccactgcactccagcctgggtgacagagtgagactccatcacttaataaataaataaataaataaaatacagtataacaactatttacataacatttgcgttgtgttagctattacaagtaatctagatgtgatttaaaggacatgggaggatgtgtgtaggttacatgcaaattctatgtcatcttataaagggacttgagcatctgtggattttggtatgaggtggtcctggaaccaatcccctacagatatcaagggatgactgtatataaagtgattgtgataagagaaagatttcctcactggttctgcagtccaactaaacttgcttttcagaaactacgcatgctaccatctgtctttgatattctattaagaaacagagtaaaagactgtaatagaagaacacataccaacacatgtacttacttccttgtggtccataaaacttcactacaaattcattaagtcctcccaggatcgtaacctcatgtttactctcgatgctaaggtggacggtaaaggaaattacacaggctttacagtatctggcagaattaccaataacaccccaggcatatgccacttaaagtgttaccaaaatttggcatgacattgataaaatatacataataattctggtagtttaggaggaggcaatatatactcttgtaagaagatatgcatgagctttggattcagagacggccgttcaaatcccaggaatgccatttactgagtttttgagcctagccaaaataatgtcagtttactccctgagtctttgttttctctttgcaaattgggaaaacagcatttcataggatttctgtgaggattagacaggttaaacatgtaaaatgtgtaagactgcattttgcctatatacataaaaaactggccagacgcagcggctcacgcctgtaatcccaacagtttgagaggcctaggcgggtggatcacctgaggtcaggagttcgagaccagcgtggcctatatggtgaaaccccatctctactaaaaaatacaaaaattacccaggcatggtgatgcatgcctgtagtcccagctactcaggaggccgaggcaaaagaattgcttgaagttgggaggtggaggttgcagtgagccgagatcacatcactgcactccagcctgggtgatagggtgagactcagtctcaaaaataaaataaaaaatatacatgaaaaataggcgcttaattttagcttttctctccctttctaccctctcctcctcaatctatccctaatgagcctgtcatataaacccagtattccctttagtcaaattcaaatgttcagcaaaatacaaattcccctaaactggaaatgctatgctcctaaaacgagggatttactaaggagagttcccacaattgtctccttggcttatggaataatcaacacagttaatgatacaaccttgccacaagcagtactgccaaatgcaaaagaccaacaaaacaaaaaaaaattttttcagatcttatccatagcatctgttttcactgccccccaaactccaccttcttcagacttgcctcaaggtttggtatgctccagggctctaatcacagaggggtaacatggctgtgctcccttcctctaaaacttacctacccctgagattcttgcccctttaaggtgctaagattcaattctagaaaccaaattaattcatattagaagagaggactactcgtttaaaatctgttctatgtatctgctttgcggtaaaatccaaaaatgattctcagtaggaattttaggtgacagaggctttgggaagctctcaaatcccactgtaacattaaaaaggaaaacacaatagattggtctcatatttctccatcagcagtgcaaattatatactgttaatacaaaacagaaacatttaaaaagttttaataatctcatagagaataaatatttttaaagatttgaaattaaatatttggcactccaagcccgtgtccaatgagacacagaactgactgcaagaggccaggtgtaattttggtaaagtccttgctcaagagccctgagtatccacaagagatatttaaataagatagttcagtctaggctaatttgatctaattcttttctaaacgataacttactaccttagaaacatgcacactaaaatgattcaatactgtccacataggaaaactggctttatttcttgcttggtcaaatgacacatgcatgcctactctgaccagtcaccctctgacatcctgcaaaatattccaaagttaacgttaatgtaataagtaaaagcataacatgcttaaaatgttttaaaacttttttaaaaaaagcatccttgtgtcacgtaaaaaaaggcaaatccagttaaaataaaattaaatatcaacaatacagcccttaaagaaaacagacatggaaaacacttccatagtgtaaaagacaaatgataaactaggaagacaaaaatgtggattttaaaaataagttattacaaagcagcaagaaaaaaatacaaataccccaacaaagaaaaagccagaacatccaagtcaagaaaacggaaatgggtaaaactgaagtataaaaaagtccaattcattaaagaagtttaaaaagatatttcttcactataaacaatgaaaacaacgaaagagctggataaaatctagtgttcagtggagtacgaattagtacttctgaggacaaatccagcactatattccaaaacttaaaatgaatttactcttttattcaaatttcacttatatgaagttatttttttaaaaatagacactgctggtgagagtgtgatatggtttcacccactttgaaaaactgttggcagtactaaacctgcacatatgcataccctatgcctgtcagcgctactcccggagatacgcccaatacatatggatagttacattcaccgaaaccgatgtttaagaatgttcacaggactatttgtaacatccaaaaattagagacaatccaaacgttcatcaatggcaaaaagaataagctgtagtatagtcacccaaaagaaaattacaaagcattaaaaaagaaaaataggctgggcacagtggctcacgcctgtaatcccagcactgtggggagccagggcaggcggatcacttgagatcaggagtttgcgaccagcctggccaacatggcgaaaccctatctctactaaaaacacaaaaattagctgggcgtggtggcgggtgcctgtagtcccagctattcaggaggctgaagcaggagaatcgcttgaatccggaaggcagaagttgcagtgagctgagattgcaccactgtactccagcctgggcaacagagtgagactccgtctcaaaaaaatataacttaaaaaaagaaaaaagaatgaattgatacacataatgtatgggttttacagatttcatcaatgaactacaaaaataatttctctacaaaaattagccaggcatggtggtatgcgcctataatcccaacaacttgggaggctgaagcaggagaaacgcttgaacccaggaggcagaggttgcagtgagccaaaattgcaccactgcagtccagcctgggtgacagagtgtgactctgtctcaaaaaactaaataaaaaaataataaaaatttctgtactttggccaggcgcggtggctcacacctgtaatcccaacactttggggggccgatgcaggtggatcacgaggtcaggagatcgagaccatcctggttaacacggtgaaaccccgtctctactaaaaatacaaaaaattagccgagcatggtggcgggtgcctgtagtcccagctacttgggaggctgaggcaggagaatggcatgaacacgggaggtggagcttgcagtgagccaagaatgtgccactgcattccagcctgggcgacagagcaagactccatctcaaaaaaaaaaaaaaaaaatttctctactttttgtatatatgttattctttaataaaaagtttacaaaaataagtgtttctgataaatctgcatatatgtttcctggaatatttgaagtttaaaaatggaaacggtctaaacatttatcaataagaaactggttcaacgaattactattttttttttttttttttgagatagggtctcactctgtcattcaggctacagtgcagtagcatgatcacggctcactgcagtctctacctcccagtgatcctcccacctctacttccccctagctgggcctacagcaggcaccaccacacccagctaatttttttagtttttgtagagacagggtctctctctttgcccatgctggtcttgaactcttgggctcaagtgatcctcccacctcggcttcccagagtgctgggattataggcgtgagccaccatgcctagccaggtgaaatgacttataagccatttatacaataggtggctggctgcactggctcatgcctataatcccagcactttggaaggcctaaggcaggaagattgtttgagcctaggagtttgaggctgcagtgagctatgattgtgccactccactccagcctgagagagagagaacttctcttaaaaaaaaaaaaaggcaaaaaacacaaaccacatgcagtaggctactaatagtgtgtactggtgtcctctttccaaccagagctccactaatatatgtgtctgttcaacttgggtatccagaagaagtcaactgaatttagttgtacaaagatattccagcccttaaaactgacaaggataatgaaagaacggagtagtgcagaagattaaacgagtttaacaaaagaagtcttaaattaattttataacataaaaatccacagatgcagcattctccatcaatcagaactaatttgctatgaatgacactgatctactgcaattacttttaatcatttaaaattacgagttgtccttgtggatgttgcttctgggaaaactgaagataccttttctatcctttacctggatgcgataaaacgaggttccttccattttgcggtttgtttggaattcagtccatacttacgtgtattttataaagaagatcctccaagccttctctttcccatgatccccagtaatagcccacatgccagctacaatgggattgtctttaattatatatcacatcataaattaaagagttctcatagtctacctcatatgaaaacccaaaagcaaactgaactaaacctttaaaacttttaccaaaccagtaaaatgagaagctatgctaactttatgctgccttggaatggacaggcactaaatgagatagaaaaaagaatttaggtttagtccaaagaaaaacactgcattaaaaataagccattccatcaccactgaatgaatgacttgccacaaaatatataataattacttcactgctgttaccacgtgtatttatgggagagaccacgagtttctttctcctctctgctgcaaagtcaagggcaaggaaggcactaagaaggcaggttaaaatgacaaaaataatgatcgatttctggatgtgctggtcaggctgggagactggtgggactcactagaagattcctcattactttctctgtttcacagcttaaaaatataaaatatccttcagacattgttctggtaaaaactcattaaataaacccataaatcacattttatactcatcttttttgatcttattcacaaatactgctttatacccacttagcatttcactattaaggggtatcaccattttgtgtagaataatgattaacattcccaagaacccaagtccatttcactttttaaagtgccagccacctaccacattattttcctggaatgccattatgattacacaatctaatatttaaaggcaaatgccaaactgtcaagagataaatgacattcttggcaaaatgtgtctgtcagagttttacaagtgatttttatacagttctgaaattttccagaaaggaagccaaaggcaatgtctgggccttaaggactgacaataacaggtcaaggaccaaggattcagggaccactgagtcctaaatttactgataacaagttcataaaataaaagagtgccctccctgagctgtgtggaagggaatgaggtcctggcataaagaacgcgcttctgtgcagagggcagaagcaagtcgtgtggatttctgtgttcagacccacctgcttcctactctcctggagatgagtcacactaggaaagctgaagaaacttggcaattttcactacctggttttttgttttttggtaaaaaaaaaaaaaaaaaaaaaaaaaagatatgtctgttaatccattaatatgtaagtatcacaaaaatagtgctttgggggggatatgtttacaaggaatccttctcttttagagacataaatggaaatatttactaataaaaatgtttctaggatttgctagtaaataacccagtgtgggtagaagaggtgtagaagaaacagtagagggccagcaacgttaatgattgaatcctatgttaatgatcgagtcccagcggcacatgatttgttacactgttctcactatttttgttttacatttaagttttccataatacagtaaaagttctttaaaacctaataacatagttatcatcaaaagtttagctttgtagaggcataaagcttagctactagagctaagaacaagaactagaactagaatttagctactagagctctcttgaactttttttttttttttttttttgagatggagtcttgctctgccacccaggctggagtgcagtcgcacgatctcagctcaccacaacctcggcctcccaggttcaagcgattctcctgcctcagtctcccgagtagctgggattacaggtgcacaccaccacacccggctaatttttgtatttttagtagagacggggtttcaccatgttggtcaagctggtcttgaattcctgaccttgtgatccacctgcctcagcctcccaaagtgttgggattatgggagtgagccaccacgcccagctaaaggtgatactattaatgaggcccatgcctggcctctcttgaacatttatgaaacaatgttaagttttcctgaggtgcgacagtttgaagaagacaaaaaatagcaagtgatccagtatttaagaaagcaaagactggctgggtgaggtggctcacacctcctgaggtcgggagtttgagaccagcctgaccagcatggagaaaccccgtccctactaaaaatacgaaattagccaggcgttgtggcacatgcctgtaatcccagctactcgggaggcggagattacggtgagccaaagttacggtgagctgagatcacaccattgcactccagcctgggcaacaagaatgaaactccgtctcaaaaaacaaaacaaaacaaaagcaaaaacaaaaaaaccaaagactttacattgaaagagaagcatactctgctaacattctgaaggaaacaagttcaagtggtttcataaggatgtctatgaaaaatacaatcacatggaaggaagacaagcatgtgtctgtatatccatgacaaacagcctctaggcaacatgctaaccaaagctcttaaactacaaggaaaaatggtcatgtccaacagaaaggctcctgattgaaataagaagctgaaaaaatttttaagggtttttaatgttcttcaaatgaagagggggaagccttttattcaaaagagaaattgaatggcagaaataaaagctattcagaaaatgagcattatcttgggaaaggtttgctaagtaaagaaaaaaagaaaagtggcattgagaaaagacaatgggaagtgggctgctatcagtgatgaaatccatatgtataaagatttagggaccattgcagtggctcacaactgttatcctagcacttcaggaggctgaggtgggaggattgttttgagcccaggagtttgagaccagcctgggcaacatagcaagacccttttttttttttgagacggagtctcactctgtcgccaaggctggagtgcagtggcctgatctcagctcactgcaatctccgcctcccaggttcaagccattctcctgcctcggcctcccgagtagctgggattacaggcgcctggcaccacacctggctaatttttgtattttcagtagagacggagtttcaccatattggccaggctggtcttgaactcctgacctcaagtgatccgttcgcctcagcctcccaaagtgctagggttataggcatgagccaccacgcccagccacaaaaactactcttacacagagactgccttccagaagtttgaagtctagcaagggaacacgagatctgttcattaagaagtacagaaagagtttgcataaagtaatactatagcttagagtaggagagatttcttccagcccggagggagggatagggatggtctgctatggaaggtaaggacttacaaaatgtcctaaacagagtgtgatttggacatgtcgaggtgggagaaggaatttaatgcaaagatttagtatagaactgattcaggaaactgagaacaatacatttttattttgatgagtggaccctagggaatactagaaagtaggccaagaccagattacggagggctccgaagtgtggattttatctggcaaacagggaaacagtattccatgcacagtgcatctacctgtgctttacaaagataacccaactgtggtgtgtaggactggctgaaggtgggaataagcagagttaaagcaaaagagtaggaaagaaatattcaagacctcaactaagataacagccacatgaatcatgggacattaaacagagccctcacaggccttcacagctgaacagacctggcagagccagtagaaagctccaacgttgctacaatgtctaattttcatgacaaaacaaaaaagcagatctccaaatcaatcttctaatttctaattcaagctctaaatttctaagtgtaaacaaagtatatgtgctccaatgtctccctctcagtgaggccttctgggatatcctatttacaaccacttactcctaacattcccaccatgcaatatactatgtattttacttttatctcctactgcagtgcaagctccgtaagagcaggaattgtttattttgttcacagaagagtacccagcaaacagtagactacaaatgaacatgaggccgggtgtagtggttcatacctatttaatcccaacactttgggaagcaagggcagaaagattgcttgaggccaggagtccgagaccagcctgggcaacataacaaaacccagtctccacaaaaacaaaatttttaaacattagccaggtatggtggtacgtgcttatactcctagctaatcggaaggctgacaggggaggatcacatgagcccaggagttaagttagagaccagcatgggcaacatagtgagacccccatcactacaaaaaacaccaaaaaattagctgggcagggtggtacgagcctgtagtcccagctactttgacggctgaggcaagaggattgctggagcccaggagtttgagtctgtagtaagctatgatgacactactgaactccagcctgggtgacaaacatagaccctgtagcttaaaaacaaataaatttaaaaataagatgaacacatgaatgaagttgccagtctgagaccttaattttagcctctcagacaggtaaagtgataccacatatatatatacacacgtatacatacacacgtatatatacacacgtatatatatacacgtgtatatgtatacatacgtgtatatatgtatgtatatatacgtgtgtatatatatgtatgtatatatacacatatatatacacacacttatatatatattttttttaaagatggagttttgctcttgttgcccaggctagaatgcaatggtgtggtctcggctccctacaacctccgcctcccaggttgaagcgattctcctgcctcagcctcccaagcagccgggattacaggtgcctgccaccatgcatggctaatttttgtatttttagatttttgtatttcaccatgttggccaggctgggattgaactcctgacctcaggtgatccgcctaccttggcctcccaaaatactacaggcgtgagccactgcgcccagccaacggtgatactattaatggcaaagtgaaacacaggacagcaggaatcagttttgtaatgaaagacactattagtaagtttacttttgaaaacactaaatttgaggttatcagtggataaaccaagtggcaatatattataaacagctggaaaactcatgacttaaagaagtcaacttataggctgggcatggtggctcacgcctgtaatcccagcactttgggaggccaaggcgggtggatcacaaggtcaggagtttgagaccagcctggccaaaatagtgaaaccccgtctctactaaaaatacaaaacaaattagctgggcgtggtggcgggcgcttgtaatcccagctacttgggaggctgaggcaggagaatggcttgaacccgggaggtggaggttgcggtgagccgagattgtgccactgccctccagcctgggtgacagagcaagactctctcaaaaaaaaaaatagtcaacttataaatcaattaaatctgagcctcttttttaattttttatttttttttgagacggagtttcactcttgttgcccaggctggagtgcaatggtgccatcttggctcaccgcaacctctgcctccccagttcaagagagtctcctgcctcaacctcctatatagctgggattacaggcatgcgccaccgcacctggctaaatctgagcctgtttcttaatctctaaacaaagggggaggggatgcagggaagggacattacctcactcacagaattgtggaaaattaaatgaaatactgtatatccaaaggtaccaggcccagcagctgacacaacaggaacttaatttttttaatgtaaaaataaataggccgggcatggtagctcacgcctataatcccagcactttgggaggccaaggtgggcggatcatgaggtcaggagttcaagaccagcctggccaacatggtgaaaccccacctctagtaaaaatgcaaacattagctgggcatggtggcacgtgcctgtaatcccagctacttgggaggctaacacagtagaactgcttgaacagggaggcagagattgcagtgagccgagatcatgccattgtactcagcctgggttacagagcgagattgtctccaaaaacaaaaacaaaaaaaaaaaaaaaaacacacacacactttacctaaatgaattgccacaaaactaaaattcaaagtttataaatgtagtgtgtgtgtgtgttagtttttttcctacattcttaagcagaatactaaaaaaacatgctacacctttttttttttttttttgagacggagtcttgctttgttgcccagactggagtgtaggggtgtgatctgggctcactgcaagctccgcctcccaggttcacgccatcctcctgcctcagcctcccaagcagctgggactacaggcgcccgccaccaggccaagctaattttttgtatttttggtagagacggggtttcaccgtagccaggatggtctcaatctcctgatctcgtgatccgcccgcctcggcctcccaaaatgctgggattataggcatgagccaccgcacccggcctcaacctttcttttttttttgagatggagtcttgctcccatcgcacaggctggtgtgcggtagcacaatcttggctcactgaaacctccacctcctgggttcaagcgattctccttcctcagcctcctgagtagctgggattacaggtgcacaccaccacgcccggctaatttttgtatttttagtagagacagggttttgccatattgtccaggctggtctcaaactcttgacctcaggtgatccacccacctcggcctcccaaagtgctgggattacaggtatgacccaccgcatccagccaactacaccctttcttgatgctgggtcatcattatgaataatagttgctatactgtactacaaaatacaaggatacccttaggaacaaataaggaatatacttattttttgctgtagaaaatttcccatactgttatgctaaagtccttgcattgagaggttcttttcctagtttctctttgttcttaacctttagctatgtttgggagatgacactgggctactatcctttaaaatgtatctatagtaggctagaaaaatcagataactgaagttcatgagattactttatgtttaaaaaaaaaagggtaaatatgtcctaagaaagacactctccaatcaataaaatatgtaacttttagcaggtttacaactaaattagttggctaaagctgtcaaacagcttctgaataagggaagtatcacttatttaaaaatagccatttcaaaataaatatgtattgcccagaagcaaaaaaatatctggcaacttactatggtaccctgaatatttaaagacccattatcttaggagtaaagagtaacatacagttttaaaattttacagagtcaactggtacgagtaaggttaaatggcaagcatgttcattaccacctagcagactaaatcagtctagccttaggagaggaaatttttcttctctagtgttatgcttcatttagagtttctatgtcacaagccaaacataggcaaaaaccaagtaaatgttacttaaataggaaaatcatcactataacttggcttttccctgaatgtattattcctccagacttccaaataatagagtaaaaaattttcaaagaaaaattaagactcatagaaacattttaagacaggtttatcagaaagataagaaatctaagtaccacacccccatccccaacaaaatatttttaaaagcagatttacaaagtcagatagtcaaagtcagaaatgatccaactgcagaaacagtttcagagagagaaaagtgaagggaaatagggaaaaataatgataccatcttgagagcaaggaaatatagtcaaaacaaaaaataagattttgagagaaattccaacttcagttacgcactttaaaatatttagaagctagaaggctatcgatgaaatatcaatagctccttaataaacaaacttgactgctttgctgttttatggcaatagtgcatatttgcttacttgcaactgaaaattacaaatttacataatgtacaaatgcatgtatataaattagcagtatattagctaaatagtatattactctcttaactcctaaagggttaatcaaaagcctacttttgggcctggcacagtagttcacacctgtactcccggcactttgggaggccgaggcaggtggatcacctgaggtcaggagttcaagactagcctgacatggcaaaaccctgtctctactaaaaatacaaaaatgagcagggcatggaggcacacacctataatcccagctacttgggaggctgaggcaggagaactgcttgagcctgggaggcagaggttgtggtgagctgagatcgtgccactgcactccagtctggcaacagagactctgtctcaaaaaaataaaataataaatgggaccaggtgcagtggctcacgcctgtaattccaacattttaggaggtgaaagcaggcagatcttttgagcttagaactctgataccagcttgggcaatatggtgaaacaccatctctacaaaaaataaaaaaattagctgggcatggtggcatgcgcctgtagtcccagctactcgggaggatcgcttgagcccaggaggtcaaggttgcagtgaaccatgtcacgccactgcactccagcctgagcaacagaacaagaccttgtctctaaataaataaatgatgtgcttttgtttcatatctaatcccatcttttttttttttttttttttgagacggagtttttgctcttgttgcccaagctggagtgcaatggcatgatcttggcccactgcaacctccacctcccgggttcaagtgattctcctgcctcagcctcccgagtagctgggattacaggcacacaccaccatacccggctaattttttgtatttttagtagagatggggtttcaccatgttggccaggctggtctcaaactcctgacctcaggtgatccactggcctcagcctcccaaagtgctggcattacaggcctgagccaccgcgcccggcccatacccatcattttttttttttaacttcttttctcaaagtacatcctacttctatggaaagattgacactcactgtcaaataaccatcagctagtcaagcattcagtttaaaatctgcaaacttggactgaaccgcagagaataaagtcctgcaagattctcaagacatgagacacttcagagatattaacaagtccacaatgaaattccaaatctagaaaaattgttttaaaaactttttggaaaacttttagaaggtaggaccttaaaagacatctggtacttaattaaaatccactttttctgctctcaggaaattataaaataattagacaacaaaaatctttcctggttaactgtaggcctggaggcaaacaatgagctgtgcatctgacatgctgtgcagaagtcccaagtggcatttagttatggctgtcacacagtctctagcacctgtcacatgggggctatggcatgaagggaagcacaggcggaagacctagacctgcaaattctaagggtggaggggagacgaaaccattgcgcacatgagaaaaacatgcaggaagaaccttgtcattccaaaggcagaacctacctaatcacaggaggctggcaagacaaggaaaacaaatcacaaccttaaaaatgacaatagcaactcaccttgaaaacttccaagtcataggcaacatataatttccccgtaaatgatacaaagacatacaaataatcaggtggccctctgcaaaatcctaatgaaaacatctatttatttcttccccccaactccctctccccaaaatatctatttaaaaacatcctactaggccaggcacggtggctcacacctgtaatcgcagcactttgggaggtcaaggcgggtggatcacgaggtcaggagatcgagaccatcctggctaacacagtgaaaccccgtctctactaaaaatacaaaaaaattagccgggtgcctgtagtcccaactacttgggaggctgaggcaggagaatggcgtggagcttgcagtgagttgagatcgcgccactgcactccagcctgggcaacaaagcaagactctgtctcagaaaaaaacaacagaaaaaatcctacttccccttttgggcggtatgtgtctttgctataccactcaaagtgctcaacacaaagcaacttctcaataaaaagctaaatttaatatgactttatggagtatctatgtagtgcctttggtattcaagtttccagtgttctttgaaaaatcttggctgggcgtcgtggctcatgcctgtaatcccagcacttcgggattcaaggcaggtagatcatctgaggttaggagttcaagaccagcctccaatgtggcgaaaccccgtctctactaaaaaacacaaaaaattagctggacgtggtggcgggcatctgtaatcccagctactctagaggctgaggcaggagaatcgcttgaatctaggaggcagacgttgcagtgagccgagatcacaccactgcacaccagcctgggtaacagagtgagactccgtctcaaaaaaaaaacaaaatctttaagaacactgcttccatttttcattttattttcattgtatttatttatttactgattgattgaaacagggtctcactctgttgcccaggctggagtccagtggcgagatcccggctcagctcacggcagcctcgaccctcccaggttcaaatgatcctcccacctcacccaccccagtagcttggattacaggcatgcatcagcacatccggctcattttttattttttgtatagatgaggtctccttatgttgcccagactagtctcaatctactggtctcgagtgatccttctacctcaggctcccaaagtgctgggattataggtgtgagtcaccttgcctggcccttttctgtttttccattttaaatacagtttttactctaacttgacatatagactgcaatgccactcaatgaagatagcatttagctaagtcagtgcacaaaaatctctattcacagaccttttaatcaggcatttatgaatcattcacagtaagcagttaaattttacgaggaaatattttctttggcattcttcatagtgacaaatagttacctctgtagagtggtgggtgataattaataaataccaagctgcggtacccattcagcagataaagatgatcaaagtgtgaataatggatcataaaaaatgtgcaggaagagatgccagatatgccatcatccccttcctcttacattacattcagcgcaccccaaagtcatggagccacttactcgaagacccaggtccacaaaccagaccatgcctcatcttcctttccttccctacactggataattaccagtttatgtctctagagattgattccccatcttaatgacttctataatataatctcaagaaaattcttgaaactcaaatacctataaatccagaggaaaaaggaaaaggtaacacatatgcacatataaataatgaatttgctcttataaagaggttagaacccactagtctaaagctctaatcatagtctgctcgttctccagttatcttgcataatatgaatggctgacccctgctgctccctttactacttcaagttcattaggcatagcaggtgtcaaatattaagtggcactaatatcaatttaaccttgatttcataaaacttaaaaaggggaagagaatactagacttcggcctttttaaagcaatacatgcaaaaagaaataaagtaacaggttcaaaattactgtcaaggttttattctgaaaaaagcaaaactacagatggatacactagacagaatgctaaatgcaatctacatgcagagaactctgcgttccaaaacaaatgaatatggctttattcaactgggcccagtttccattgtccctttggaagatttatgagaggcagtacccattatctgttggaagtttgataaaaacttgtataaacagtgtttaaaaaaatcaaaaagtaatctaaagagatatagaaaaatagtgtcttcttgattgaaattctgcttaaaaactatacagaagtgtagttaacaggaaaataccttatttgataatacgttcaaatagctattataagctgcctgtatttattatctttatcaacatttaggatgaaagaagtgggataaaaaactttcaacaaaaactggaatgctgctttttaaaaaaacccatagtgaaaataagcaaaagaaatgaattattttatggaaaaaaattgctgttaaagaaacaccctaccataagaaaatcacaccaatatgagtaaataagcaagaaaaccctggaaagtcaagggaggtgaaagtagactgtatctaggtgtgcaatgtgatacaacaagagtggtagagctattttcagcatcatactactaacaggtgatagatctcagagaaaaagccaccctgccatattagcaaaactgctagctcaagaccaacagaaatgattaacatacagttaagaaatgatctgtcaggtacaattaggacatatgaagtgataaacagtataaaagaaaccaacctaatcacttaagtagaagtttagatttaaatatgcatcaacaataagaatgaaggctgtattgttatgaagtatgagaaggaaattaaaaatcaagtttctcacaaggagtagtacttcctgaagaactgaataatatgaaaaaaatcaagctatttagcaaaacaacagaaaacaaacctagacacaacagtggatgtatatatagtaagaaaacttgacattgaaaaggtgaaaaaactattgagtttccttctctcgtgtttgcaccacggagacaagtagaactgataggctcaggtgccaccatgtgagatgtgctggtgcaatcagagggcacagtgcagaggagaatccctcctgaaagacacaagagcaccctcaatacaaccaaataacctcatcagatcaagtgttgagttgcaggcctttttttttttttcttgtcttttaaaaacatgactggggcttaaaatagcctttccaccccgcaacttctagtcccactgcctagatactaccattgcttatgcactttccatagagatgtttatatacacacacatccacgtcatcacatacacaaagacatgtaggtacaaactgttctgtaaatacctctgcccatgcatctagggaggatatgtttgaggacatatagatctaagctcctttttttagtgcttgtataatgtcaatataccataatttacctatccgtaatttcatatccattagtgaataggaaggctgttgtctgctgtttgttttgttttgttttgctattagttacaataaacatcccagtacatgtctgttggtatactttttcaagtatctgtttgcaatttctagaagtggaacttctattcaaagggctgtatacctaattttgacatataatgcttaaatatccttcaaaaaggttgcatccagttactttctaactaccatcacctaagcagacctgtttccctcatgctctcaccaataccagtattaaagcttttatagtaaaataaagttcacctttaaacaccacctcaattgccaaacgcagctcaaattgtccagtgcttttttttctctcatgctgttcaccaatccaacagagccctggctaggtgacccatggggaaaagcatgcttttcacagggattcgctctactgttccttcttgcctctttaacacaacacgtgcatgtgctcaggattcacgaacaaaaacttactaagatatgaagcacctttcatcaactatctcaaagagaaggctaatcaattaaatctcacctaacgtgtgagacaggttaactccagaacctgatcagaaaaaaacaaaaacaaggacagagtttagtctgatacggcatcacttaatcaaacaacaaggagtagtattttacctacatctcaaacacttaaaaagtatttgtacttctaaatctgtgcccccacagggctggacaccatggctcacacctgtaaatccagcactttgggaggccgaggcaggcagatcacttgaggtgaggagtacgagaccagcctagccaatatggcaaaaccccgtctctctactaaaaatacaaaaactagccaggtgtggtggcacacaactgtaaccccagctactcgagaggctgaggcaggagaatcgcttgaacatgggaagtggagactgcagtgacccgagatcacatcactgcactccagcctgggctacagagtaagacccatctcaaaaaaaaaaaaaaattaaaataataaaataaatctatgcccaaaataggatatgaagttaacttcttatttcttaggtggacctgatacgtcaaatagctccttattccaaactactgtgctattacagcatgcaaaataatgtgttctcacaaaagaatgacatggatttaattatctcaacatccaacattaatgtaacacatatgttactctccaatttgctaaaagccatagagtttacccttgactacttaaatgtgagatcccatagaagataattcaaacacatggaagataattcattgtatctatataacatttgtatatactatttgattttatagtttcgaatattatcaaatgactttctcacattggagtatcaggattttcaacctcacccccatgtttcttcttcctctccatggaatacaatcacatcaccattgttggccaaatcactatttagagattatattatgaccatgtaaatttttttttattatactttaagttttagggtacatgtgcacattgtgcaggttagttacatacgtatacatgtaaatattattcacttctgagccatatagcatcgtatgattaagatttctttttcctttttttttttttttttgagacagagtctcactctgtcacccaggctggagtgcagtggcaccatctccactcactgcaagctccacctcccaggttcacaccattctcctgcctcagcctcctgagtagctgggactacaggtgcccaccaccacgcccggctaattttttgtatttttagtagagaaggggtttcaccgtgttagccaggatggtctccatctcctgacctcatgatccactcgccttggcctcccaaagtgctgggattaacaggcgtgactcaccgtaccaggtgttttctttttctttacagtatttttccccaaggaaataagcactgtcttaaacactaaattaataagaaaccaatgtatctatccttaatttgttcctcacctcagacagaactgtctcaacatgtttaaacacatcaagatgagtatttgtatttaaatgttttccctagcaaatgtacctttctcattatttgtggctggtgagttgtggagggaggacaggagcccaggcagtctagttcaagtctgttctttgagccaccctatttgcctctctctatcaagaccacagggcttctggagaggagtgtggcacactcaggcttgttctgatgaggaaggtgaccaacagcgagactgcacagcgccacagggagatgctggtgggatagaggtcggtgggggctaatgcacagacaggtaagtactgataggcagtagactggctggaggggaagccacatttcaacgagattttgaagaactggatgactaactgtatatgagggagaagaaagactcaagaatatctgatatttccaatctagtagatgatgacactttctttttttgagatcttcttacccaggctggagtgcaatgtgtgatctcagctcactgcaacctctgcctcccgggttcaagcgattctcctgcctcagcctcctgaatagctgggattacaggtgcccgccaccatgtctggctaattttttgtatttttagtagagatgaggtttcaccatgttggccaggctggtctcaactcttgacctcaagtaatccacccacctcagcctcccaaaatgctaggattacaggtgtgagccactgcacccggctgatgacactgttctaacaaaaataaaaggcaggcaggagtagcagaagcaagtttggtgggggagcgggggagagagaagaacaatgtggagtatttaacatgatgagacaacaagtaattgtccaacagacaacattaagtgttattaacccgttttcacttagtcctacttctttcaaagtagatctttaaaacgggaactcagcatacaaagagttctaagaaaaggctgagcaaatgaataaaaaaatgtaactttagatcttagtaatctaaggaatcattaaactacatataagtctcttaacaaaaccattacatggccgggcacggtggctcacagctgtaatctcagcactttgggaggccgaggcggatggatcacctgaggtcaggagttcaagaccagcctggccaatatggcaaaaccccgtctctactaaaaatacaaaaaaattagctgggcatggtggcaggcagctgcaatcctagctacttgggaggctgaggcaggagaatcgcttggacctgggaggcggaggttgcagtgagccgagatgcaccattgcactccagcctgggcgacagagcgagactccatctcaaacaaacaaaaaacctgttgcacaagtgagaataagggaggctccatgggacgggggaaggctttggagtagagcaaacctgggtttgaggcccatctcccccatttcctaggaagtagcctacagcctcctatttaaggtggaggagcttgttagaaatgaacacactggaccccagtttcagactaactgaatcaaaatctccattttaacaagagtccccagtaactgagaagcaccagcctaaggcaagtgaaatgatctctaagccttgcctccccccaccatttacaaaagtggggataagcatatttaccctacggggaaactgaggattaacaggtgccaaatatttaccaagcctctatcaagaggtgttagtgtcttacatatgttacatcgtttaatcctctcaacaaccctatcatgcaagtattgtttccattataaaaaatgaatacactgtcgggctgcaaccccgtccaaggtcggactgctattgagtcgtagagctgctactcactgtggctccctgctctgcatttggcttcccattaacctcaataatgcatatgcaacctagtgcagccaagggcacagaatgtgtgagagcaagggaggaaagaagccttgcacctacagagaatctaaacactagtttaaagcacaatccacaaagttcaaaaactgtactcatataagcttaaatgactcagctgtgcttatccttgaactgattttcagataaggatgtggcattaaatgaacagtatttatttcaacagttgtgctaaaatagatcaaccagcagaatgcaacgacggttaataagactatgtgaaaattctcaataagacacagaaaactctcaatatagctttattccaggctcctgagggataggaattcagacaagaaaaggaacatcctaagagtgtctgtaattgtaggatatatttcacataaagactgaaattctcggccaggcatagtggctcatgcctgtaatcccaacactttaggagacccaggtgggagaaccacttgaggccaggagtttgagaccagcctgggcaacacagcaagacgccatatctacaaaaattttaaaactatggctgcatgtggtggctcacgtctgtaatcccagcactttgggaagccaaggcaggaggactgcttgagcccaggagtttgagactagcctacgcaacaaagcaagacgccatctctattatttaaaaaacaaaacaaaactagctgagcacagtgttacacacctgttatccaagctactgagaaggctgaaatgggaggatcccttgagcccaggagttcaaggctacaggtagctatgctggcatctgtactccagcctcggcaatagagtgacaccctgtctcttaaaaaataataagttctaggttatctttcaatcgttattttttgagtattaacattccagaaaagaatgtgcaaaattaacatttagaatcccaatttataacagtgctagttccaaacaaatctaaagtatgtgaatcactcactgtatcgacagctgtctaatttcactcatccaagcccacaatatgcctgacacggtctcagtctgccacattcttcctctcttacctttctagatacactggtcttctttcatttcctcaaacacaataagctctcttcctccccagggcctttgcaatggctatttcttctgcccagccctgatttccctgttttgacagatagcttgctgattcttatcctttaaggtgtgtcttttttttttttaaatagagatggggatctcgctgtgttggcgaggctggtctcaaactcctggccttaagcgatcctcttgccttggccttccaaagtgctgggattaacagtgtgagccactgcaccaggcctttatggtgtgtctaaatggcacttccttagagacctttccgatcacctgaagtacatgcccaacagaccatcccaattattctctacctcattctattgtctatttccttgtaggttttatcatgagtactattttgtctttttatatcctccctcacctcgaacgaaattcgacttccaagagggcaagaaccttatttgcctttattcctgacatgtagctgagtgactagcctcggctacgtgtcagtggatgctcaacagaaactggttaaatgaatagtgtgagtaggtgccaggcactacgctagacagtaggatctggaaataagagagcatctgccctctgaaagctccaagtttagtggggaaatgaacaatcaataaactaccaaagaggcagttaagagtgatatgagggttactcagcagtgctgaagaggcacactgaaggtgctcctgtcctaatccaggaggtggggaagccaaaggtgttttcaagaggtggtgatgctggctaaatgcaatgggagattagcattttgctcttatatggcagctacagtgaagttttttccaaggacatgaagtaagatggcccctcagagttcaactcgagatcaacacacaatgactgaggggagtacaagccatttgaaagagaaaatctggttttccacatagcaagattcaagtacagccagaatcaatgtattcagacatgcaaaggattaaggtatctcataaaagggtcacccctgcaagctcagaagaagaatgaaaaagaaagactggcaggggccactgaagcaactagataggggagaaaaggagtctttgttcatagacatgaggtttctggtcacaacagatctacgatgagatggtggtatcatcagattgtgtcagaccattatacatttgattcatctcattgtttttgttctaatgccttctcgaataaccttctttccaatgatagtatgggatcccagctatgtttacctatagagaccagaaacactggtacacaattaaaattatatgctggttttccagttgtacctttcagacttatgagcttggttcatctgatgccatggaagtagatctgctcttagtacacaaattagatgcttggaaggcaggggagtccccttcccaacaaaggataaggttggccagaactcaaaacagaggaggaaaaggatttttgtaagaaatgtttgaggtgaacctcacagacacagaaagagaaggaagagggacaagccaaggatgattccaatgtttctggcttgagttatctcaagttgagttatcctggtattgctgatggtaataccattcagcaatcgaggaataagagagggcctaagacttacagagaggccaggcacagcggctcacgcctgcagtcccagctactcagaaggccaaagcagaaggatggtttgagcccaggagccaggagttagaggttacaatgagctatgacagtgccactgtactccagcctgggccactgagcgagacactgtctccaaaaaaaaaagacttatacagatgttccatttaggacatgttgaatctggggtctctgaaaagcagcaaagagaagatgtccagtaggcatttggccatccaagaccagagctcaagagatatggaatttttattctaaaaacacattcaggcaataatagatgaaatcactcaagaatagggtactaactaccaagagataaggatgaactgtgaaaccccgagtaaagccatttttttttctttctttttttttttttgagacagtcttgctctgttgcccaggctggagtgcagtggcgccaccttggctcactgcaacctccacctcccggttcaagcgattcttgtgcctcagcctcctgagtagctgggattacaggtgtgtgccaccacatgcggctaatttttgtatttttagtagaggcagggtttcaccatgttggccaggctggtctcgaactcctggcctcatgtgatccacccacatcagcctcccaaagtgctgggattacagttgtgagtcacgcgcccagccctgagtaaagccagtatttaagagaagaggaacctacaaggtatcctgagaaacagataggcatctagaattaagttaagtatttgttaggttatcatttaatgtctgctttcaacaagtatgcaatgtcttacagagaaaattcaagttttaaaaagaaaaaaaaatttgcttatagtaaagttactgaaaaagaaaaagttctttcagaataccgtaacatggcttcctgggacaggaaggaaaccaatgagatacaccctcctgacctcttaccagtacttcaaaaagtgcaataaagctggttgagagaaacaaagaagtttctttggagacctactttaaacgcttaatccgtgccaaaagtccaaagtccatgaagctaactacctttggatgaattttcaaggcagagataaaatctccaatgtgcactttaatgactaatactagttttgagagacattactacacatctatgctctgggacagaccaaaccttcagtctctacgtcaatggtacaacagagtactattctccccagtagtgttactgaatttgcgactcactgagttggaagagctgcttaaaggtttatcatcatcaaaagccatttattagggggtgttcttgtttttttttgagcaaagtgctaaaaactccgttgtacgtttcctaccccatcatagtttacaactttgttgggtaagatcaaatgactccaaaaaacacctctggaatttcaatacaagttgcgatagttaagtgccaaaacaagcggtatgacagctgtcgggatgcagaagtaatcagtaaagcctggatcgtgtaagaaaatggggcttgagccagactttaaggaaaggccaagcagtcaagaaggaatatgatgtccaaggaatatcataggcagggtacagctgacagcaaaggcacagatgcagcaactgtgcctagaaccagttgatcagttttattgcaataagaggttcatgtagccgggttgtggtagataaaagcagataagtagacaaaaagcaagacggtagagagccagaccacagcattttgtactttatcctatgaacagtacatagccagtgaaggttttatgccgaggtagatgacggatgcaaagcacaattttaggaaaattaatctggcaactgtgtatagaaaggttaatggaatatcatcattgtgacgaggtatacatgtgtcaaaactcatcaaatgtatacacttaaaattgctgaattttactgcatataaattatacctcaggaagaccaattttttcaaaacaaaggacaaagataaagacaagaataagcagattattaaaatacaggctggaaaaaaagtcaggctgtaaaatcctgaatatttgatagctgagattaattcaagccagctgattatacacattttttcccaacttcagcaacataacactagtagcctgaaaccagccatgatagagtatttatacctcagaaatcagcaaacattacaaatcagggctttatccccctccccagggtggttgttcaatattcaccagcacaccactgtgtaatttctatacgaggtttggcttggatatggtgctaaatgaagagttcctcgacatttcttctcactcaaaataatgacataattccgaagcaccatatcttaatcttaccagcagtagacagttatcaaaaaagtgttaagatttaagagtctaacattttactagtttcaagaattaaagcatgcccatgaataagaaacctttgtgtctcccaatcaaggtttctagctattatgtggtttgggactaacaccaactgatgatgacaatgcacaaaaaattccaccattcattccattatactaaaggctaattgcatgggcctattattggaatatgctttcctagttcaactagctgcatttcaatagagtaaagagggttttctggagaaaccctactgtgaaaagatgaactttgtcttaacaactttagtttcaaaaactattcatttatagatgcctatttcacgtctctgaagcaaaatggttcatttgttatgtagattactaagcagtcagtcacttaagaataaaaagtttcttctttagaggctccagctaactgtctgcataggttcaatctaaaaaccagcaaagcatactgctaaatatgatagcaaataattgtttaaacacaaatgagcaccaccttcaaattttccaatccactttccaagggccaatctatgattatccccaacaaagactgcctgctcctgggtttcttaccagtaaagggaagaaatggggggtcacaagaggggaataaggcaggaggtatagaatgatgttctctactgcagatctgactccatgagtccttaactaacagccttaagttttgtttcaaaagttcttaagtccattgcgtagaactcagaatgtaacttcctacacacaaaagccaatttaactcacttttatctgaagtacactatttaactctggaatattagccatcatctataccaatgcttttactaaaaaaagtaagtgcattcagagttttaattgagacactaaaaccatcatttgaacctcattgcaactggagcccctctctctcagagaaggaatacaaaacacaggagaaagatcataaagaactatgtaatataaggagcagggagaaaatgtcaggtgggaaaaatggccggaaatgggaagaagaaacatgtacaagaatcaccaggagagtgacattccccgccccactgatacctagagaggggcaggcagggggtaggtattcatcagacatgcacactttgatgaagcaccccgtgaatttctgacctacacctcaaagaaccacagctccaaggagtgagctgcaaggccatgaaaaacatacaaggggacggttcagagccccaggtttgctcactgagcattctttctaccagactccagtccaagggtcttttccttttgcttctaattgccctggaagagtagaaataagaacccttcaaaaagagaaaaatgggccgggagtggtggctcacgcctgtaatcttagcactttgggaggctgaggtgggaggatcacttgaccctaggagttcaagacctgcctagacaacataatgagaccctgtctgtattaaaaaatatataaatgtacatgtggccccacctctttagtaataaatatttaccattttccactcattcttcacaatgcttaagcccagacgcaatacaaacagttctaggatctagggacaaagagataagacacagaatctatcttctaaggagcagcttgaaagaggtgggagttggagccacaagcaaacagctgattatataaagtggtctgaggggaaaacaaaggggtcaattaaagcatacagaagacacgaaaagggttgaaaacaaatatagagggggggtgattcaaggaaggctttgagtaagatgcaaggcttgaggtgaatattgaagaataaacaaaagttgccaggcacggtggctcgcctataatcccagcactttgggaggctgaagcaggcatatcacctgaggtcgggagttcgagaccagtctggccaacatggcgaaaccccatctctaccaaaaatacaaaaattagccgagtgtggtggcaggcacctgtaatcccagctactcaagaggctgaggcaggagagtcgcttgaaccctggaggtgaaggttacagtgaacggagattgcaccactgcactccagcctggacaacagagcaagactctatctcaaaaaaaaaacaaaaacaaaaacaaaaaggccaaaagagaaagggactctgtagaagagttaggaagtgtcccttgagaaggctaggggaggggagaggcatacagcacagcattgtatctttgaccgatggtaggaaggcactacttctctatcaaactgacttttaaaccaagactccatcaaaccgatttttataccaaggttaggctttaaaccatgggtgctaaagagcaactaaggagttttaggcaagaagtagcataatcagatgtacaaaaaacagtatcatgcctgtaatcccagcactttggaaggccgaggaaggctgattgtctgaggtctggagttcaagaccagcctggacaacacggtgaaaccccgtctctactaaaaatacaaaaattagccaggtgtggtggtgggcacctataatcccagctactcggaaggctgaggcaggagaatcacttgaacccgggaagcggaggttgcagtgagcagagagcacaccaccgtactccagcctgggtgacagagtaagattccatctcaaaaaacaaaaacaaaaacaaaacaggatcactctggcagccaagatgaaaggcagactggaaggagacagactagatgcagggagccctgaagttgtgagattatctccaacagtccaggtaaggtcccgaggccctgaatcaaacagtggtggtcgcaatggagggcagggttgggggagagaataaagaggcagaacaggtcaggcatggtgactcatgcctgtaatcccagcactttgggaggccaaggcgcgcagatcacagggtcaggaaaatgagaccatcctggctaacacggtggaaccctgtctctactaaaaatacaaaaaaaaagttagccaggcatggtggcacacacctgtagtcccagctactcaggaggctgaggcaggagaattgcttgaacctgggaggtggaggttccagtgagctgagatcacaccattgcaccactccagcctgggtgacagagtgagactccgtctcaattaaaaaaaaaaaaaaatgaggacagaacaaacaggatgagggaggttgttaagacacacaggtttcccacttcggcaataggtaagtaaacaaaaaaacagattgtagtaagagtttggaagaaatagtactgacatcagtattggacatgcaaggttttaggggcctgttgggatcgtcttggagagatatttggaaggcaggcacctacactaacctagagtttaggaaacaacaactcaactaaaaatgcacatatatgttttttttaattattttttagagacagggtctcactctgttgcccaggctggaaggcagtggcatcatcatagctcactgtaaccttgaactcctgggttcaagtgatcctcctgcctcagcctcccgagtagctatgggactacaggtgtgtgccaccatgcctggctaattcttaaatttttctttgtagggacgatgtcttgatatgttgcccaggctaatctcaaactcctggcctcaagcagtccttctgcctcggcttcccaaagtgctgggattacagacatgagccaccataccgggtctatgaatcattttatagcaaaggatgtgttatgtgaaaagatgactgagaatgaagcctaagggaaaaacaacctttaatacatgtacacagagagatgcaggaccaaggtaggcctttattatgagatagaatttaaaatgttccttcagtttaggggtccacgaactagggcccaccccctgtttttgtaaataaagttttactggaacacgccatgcccatccatttacgtattattgatggctgcttctgtgctgcaacagcagagttgaatagttgcaaaaaagaccatacagcccacaaagcctaaaatatttactacaggctgagtattctttatctgaaatgcatgggaccagaaatgttttggatttatttgcatatacataatgacatatcttggcgatgagactcaagtctaaacatgaaattcatttacatttctttctttttaaagagatggggtctcataatgctgtccaggctggtctcaaactcctgggcttggcgatcctcccacctcagcctcccaaagtgctgggattacatcatgagccaccacactgggctcatttatgtttcatatacatcttatacacatagtctgaaggtaattttaaacaatattttaaataattctgtacatgaaacaaagtttgtgttaagtatttatgtgtggaattttccacttgtgttacgtaggtgctcaaaaagttttgaattttggagcattttagattttggattttcagataagggatgcacaacctgtttttggcccttataaagcccgctcactcatactttactcaacggcctttaggcaaagcctatccctatttcctacctcagtttttccatttgagaaatgaaatgtacactatgttcaagttcaacaagaacttaaaaggctcatttttaataattaatcactaaaaattttcctcaaatattttgttcaacacaaccaagtacatttccaataaaagtcaaggtttcaaagaatataaaaatgtacaacattgggccaggtgcggtggtcacgcctgtaatcccagcactttcggaggccaaggcgggtgggtcgcctgaggtcaggagttcgagaccagcctggccaacatagtgaaacctcgtctctactaaaaatacaaaaaattagctgggcacggtggcgggtgcctgtaatcccagctactcgggaggctgaggcaggagaatggcttgaaccccggaggcagaggctgcagtgagccgagatcatgccactgcactccagcctgggcagcaagagcgaaactccgtctcaaaaaaaaaaaaaaaaaaagagtacagcacagaatttgactatataggatttaaattacaaggcaatttattgacttacatgtgcctacaaaataaagggaatcccaaattttactttatatccaattcagagcattaacacaacagtctactccagaaagcattcaccttgacctgttacaaaaggtcctgatcttttgtaatagaagagaagagccacacagcagagaagttattgctatctccaccaccactgccatcattttctgaacacccgccatgtctagatgccattccaagcatctaaggcctgtatgtttcattcgagcccctcaataactcatgaggacatccatccattttacagatgaggaaactgagcctcagaagggtaaagagcctttaactgggtgcagtggcatgcatctgtagtcccagttactccagaggctgaggcacaaggattgcttgagcccaggaattggaggctgcagtgagctatgattacgccactgtactccagcctgagcaagagccagaccctgtctctcaaggggagaaaatggttaagagccttgcctcaagtcatctagtagggagcgggtgacagaaccaagtctgacctcagaggctctgtacttaactacgaccccatacttttgttaccgacatggaaggagataacacttataaaagaacaaatggaatctggacactaggaaacacatatctgcttgtcttccccacttggaactcaatgcatatcttggaagccagattggtgtcagcagcttaagaaggtaacatgtattgactgtaccaatgggctctggccagacagcctcagaaccacaaccaggtgcaacatagctgccagcagacaacgtatcaagttcccaacagccacctcaaaaatcaattttttttttttttgagacagagtcttgctctgttgcccaggctggagtgcagaggtgcaattttggctcactgcaacctccgcctcccaggttcaagcgattctcctgcctcagcctcctcagtagctgggactacaggagcgccccaccatgcctggctaacttttgtattttagtagagatggggttttgccatgttggccagggtggtctcaaactcctgacctcaagtgacccacacaccttggcctcccgaagtgctgggattacaggcgtgagccaccatgcccgaccaaaaatcaaccttttaaacaactcccctccagaaacagagggaagccgacacaagaaataaaaagacctttgtaaatcagatattacagtaatgtactctaagaggtcatatgatacactcagtggcaagaacataagctttcacttcaaaccgacccaggtttgagttctggtttcaacacaaggcttatgacagtaaattacttatcttctctgagcccactcccttgatgaaataaagaaccacactctctgccagacagtccagggaattatcagtaccataatagagaatttagttgttcagagtcaaagctcccgagttatacagactgagcttatctctcagctctgcaacttacttggcatgagataggggcctaaggtttcatctttaaaacagaaaaaaagaaaacagtacctacctcttgagttattctgaggactgaggaagatatttaaagtgctaaaaaacacaatgtccggcccaggatgcgctcaaatgtcagctgttactactatgattaatgtgtctggcacacagtaagcactctaagaggcttttcattagtgtaagttatagaccaaatgacaacttccaacttcaagacctgatctttaggggaaacaatgtctttccccgaggctgtgaaattaactttcacagctttaaaggagtggcagaagcacatttcctgcaacaaaaaccacgggcttggctccctcttgttaaatggtaggaaggtttcttcacctgcttcttcacactttatttaaatactaaatacagccgggcgcggtgtctcacacctgtaatcccagcactttgagaggttgagacgggcagatcacgaggtcaggagatcgagaccatcctggctaacacagtggaaccccgtccactaaaaatacaaaaaattagccgggtgtggtggcgggcacctgtagtcccagctacttgggaggctgaggcaggagaatggcatgaacctgggaggcggagtttgcagtgagccgagattgcgccactgcactccagcctgggtgacagagcgagactctgtctcaaaaaaataaataaatactaaatactactactggtactttcaggcaggcaacacccttaacctctaaacagaacgaactattttccccacatatggttttcagagcactaggaagaaacactgaaacagaaaggcatctgtttagaagcagaactttaactccttgtaaaacagcctgcccgtacctgtggccaaagcaaaagcaaacgggctaagtggcccagaccctcctaactctgcctgtctttcaagagaactcctaccatccccagcatgcagttgcttttgagctccctttgtatctcaaaatccataaaaatgttgagtaccacagatcgttctttcaatcatcagttcagaatacagaaacagaccaaaggcaatgcaaagacaatctataatttaaaaattccttgacctctatctgcctcgtaagtccatctagctaaaatgtacatttcatataaagttcaattattaaaaagccagaaaaaatccataaaaccctctgaatcttagaaagctctctcagatgcattttaaattttcaaatagctcacatgcctgcacttgttaacttttcgtcaaatgacttcagctttttttatataggcaggtaattatattcattccaggactttaacatcctaaacacaaagtttaaccggcattataaccagcttaacagaaaaatcctcttccattaaacagatccgattcaaggggtatctaagaaaaacaggaaaacagtttccagatacagcactggcttttatccaccacagaaatcaacaactcagcttctacaaactttaacaagtttgctttaaatttctaagccatttgaaatagaatatgcacaagtggttaatgatcttgtattttcttcccacttaaaaaaaaaaaaagaagccatttatcacactcaagttctaacaattaaaaaaaaaaaaaaaagcctaccaaaaatcaaatcccaaaccacagccatcctctccagaactttgcaacagtctagttcacatctacaagccttacttttgtttggaaagctagggggaaggaaagcagcctgttttagatttcatttctagggaaatagaaatagacgcaaagcctcaaggttacacagtacacacagagaacatcctgtccactagcctaaacacactctaagcatgtacacggctaatggccaaaccacctgcaaaagttccatttgcggctgggagcggtggctcacacctgtaattccagcactttgggaggccaagaagggggatcaagaggttaagagatcaagaccatcctggctaacacggtgaaaccccatctctaccaaaaatacaaaaaattagccaggagtggtggcgggcgcctgtagtcccagctactctggaggctgaggcaggagaatggcgtgaacctgggaggcggagcttgcagtgagccgagatcacaccactgcacttcagcctgggcgacacagcaagattccgtctccaaaaaaaaaaaaaaaaacacagctgggcatggtggcaggtgcctgtagtcccagctactggcaggagaattgcttgaacctgggaggtggaagttgcagtgagccgagatcgtgccactgcactccggcctggcaacaaagcgagactccgtctcaaacaaacaaacaaaaagttccatttgctgggtctcacatgttgcctacaaattcgagattatgctgtttttcattttattttagaacagtcaccttgtatccaactgatccagcccacttttactgccaaggtgttaacatgcattacatttgctgaagacagaaagaaaatgaaatagtcccagcccctaccctgaggacacaccctcacatccctactccttctccatcagctaaactgtgtgtgtgcagatgtgtgtgtgcctgctggagtctggggtgcagggaggttggtggtaacaaaagaccatgaggctgagacaatcaactagccagggttttctgagaagaaagggcacaggcagggacactgggcaatacatgcttctgtctagttcttttcatctcaagcatggttcacgcagtaaaaggtctccctggactaaatcctgaactaataaaaagcctttattttagagagagcagggaagtatgtaattgttaaatatcaaggagctaggaaacacaattaaaactttgaactgggaggtgaaaaggaggggtaaaaaaacaacaactttgaactgtaaggtttaaaaaagttaacctacctgcataggattctcctaaattaaaaataggatctacacaatgctcagtgttgcccctgcatctcaatgaacataccaacatacctttgaatacgctccttaacactagcacaagtgtgagacttctcaccaaaagctagtatcaagtatgcacacgcgaataagtgcttactattccatgctatggttcacatctattcttttaaggcactgagaatttcaaaacacgactctctgtaatttgctctccaaaaactgcttttattagacactggcaggcctcaaactttcatgtcttaaagcaagacaaatgctcctattaaaaagggactggcagcccaggaatgccaaaagctgcaagaagtccaaagcaatctctcatatcatcacctttatatatacatgcacgcacatacagttgattaacaggaggcactccagctttctaaaggaagttcttttaactatatccatacttgctacatacaatgtagcaagagtaagagataaagactgaaagtatcctcatgaaagacattgtccaaaaaatccaaattcttttttttttttttttgagacagtcttgctctgtcacccaggatggagtgcagcaacacaatcaagactcactgcaacctctgcctcctgggttcaaatgattctcatgctcaacctcctgagtagctgggattacaggcatgtgccaccacacccagctaatttttgtatttttattaaaatagagacagggttttgccatgttggtcaggctcaagtgcccggccccaaaatccaaattcttaaaattaccaacctgtacaaagctatacctattcatatttgacaataaaaaacacctgtgaagaccatttgttgtcccactgaaaactaaggagcatgggctggatgcttgaggccaggagctcacaaccagcctatacaatgtagaccctttctctatgtatatgtttaacatgtaagaaagaaaagaaagaaggctgtgcactgtggttcttgcctgtgatcccagcactttgggaggttgaggcaggtagatcacttgagcccgggagtttgaaatcagcctgggcaacatggtgaaaccccatctctacaaaaaaatacaaaatttagccaggtgtggtagtatacgcctatagtaccagctactgaggtggctgaggtagaaggatcacttgagcccgagaggtcgaggctgcagtgagctatgattgtgtcactgcactcaagcctgggtaactgagcaagaccttgtctcaaaaacaaaaacaaagtaaaaaaaaaaaaaaaaaaaaagcaccaaaaaacaaggcacatggatgaaaggaaatgtgtcatatgctaggaaagaatagaaaatgaccaactctagttcaaaggaaatataataatttctattatctacctgtttcaaaaagactatagtaaacagctaagctaatgcgtttgaaactgaaattaagacaaaaacttgattgaccatcacgtttaataccagaatccattcctagacttgtaaaaacaaaataaaactcctgttaacaccctacttaaaaccttcaatgagtctggtgccggcagcatacaactccacctgcctccatatctgcaggctctcctctgcttattccttggcctcaccaatcctgggactctacagtcatgaacactcattaagtttcttgaataatgtggttttacagctctatgcctttgcctcccctccacccggaatgcccctcaactccacagctctctgaaaatgcccactcatctttcaagaccaaggtcaaacttcatctcttggaacagccccatttccctaggcaggctgcacattgcaccccgttgtgtgtccctttgccactcactgggagacaaagttcatctctctcctagaatgcaagctccctagaataggaaagccatgtctcacctctcttgttaccatctttactgctttgcacagggtctgacagaaagaaggcaccaaaaatatttgactagaaaataaactgagaaaacactgggataccatttcacatccatcagataggcaaaatgttagaaagctggataaatgatggtgtggatatgaataaacaggaactctcatatgttgctgatgggaatgtgagtttggtaaaattactttgaagagtgatatttttcatctctcgccaagctgaaaatgagcactgtcaaagcagcaattctgcttcaggttacatacattagactattatttgtcaaatattgtcctgatcagcttatttttaaatgaagggatatttattcatatctcaagtatgcatctctcacattgtatgcgtaaatattttttcagggtaaatattttataaaactataatttctattacatgtaaatatttatgcatatatatatgaacattatgcaaataaacacacacatattttgggtatcaatgtaaaatacatttcttactgtgtctagtgaacaaaaaaggcttgaaaaacactatcccagaaaaacacatatgtgctcaaaaagacactcataaatgttaattatgacactgtatataacggtgaaaaactggaaataacctaaatgtgcattaacaaaatggaaaaaatatggtacacatataactcaatataaatgaactggaaacaaatgaagtaaagctactagaatacttctaataatatcaataaatcttaaaagtaatattgaatcaaaatgtatatttatataaacatacaaaatactacatacatacatatatgagaaaataaacatgaatggtatgatgacaattcaagaagacagggagggaagcggaatcaggaaagacatcacaggaggctttagtgtaacttcaggtgttattacctcaaaaaaaagttctgaagacaatgttaaaatctgacaactgggaaatggatgctgttcattattttattccacatatttgttgtggtgcttaaaatattttgtcattgaaaacaatgtaataaacaaatgactagaaaaagtcaaaaaaaaaaaaaaaaaaaaaagcaatctttaaaatgtcctggtgttggccgggcacagtggctcactgtttaggtggtcaaagtgggaggatcacttgaggccaggagtttgagaacaacctggacaacctatcaagactctctgcctctaaaaaaaaaaagtcctggtgtttatagttccaaatcaatatatattacacgtgatttttttttttaaagctaacattggtgtgcttatgtgttagatactgtgctaaccactactacacaatttcacttacttggtaacaatgaccctttgcagcaggtaccattattttctgctagactgtgtcactgtctctgatctttactcttgagggtccaattgtactcatcattctatattttctaagggcagaaaaatggactcatctatttagagacagggtctcactctgtcacctaggctggagtgcattggtgcaatcatagctcactgcaggatcaacctgctgggctcaagcaaactttttaaaatatgcagctacaaaagcaaatttaaaccctaatttaaaagctgattttgccgggcatggtggctcacgcctgtaatcccagcactttgggaggccgaggcgggcggatgacttgaggtcaggcgttcaagaccaggctggccaacacagtgaaaccctgtctctactaaaaatacaaaaaattagccaggcatggtggcacacgtctgtggtcccagctacttgggaggctgaggcaggagaatcacttgaacctgggaggcagaggttgtagtgagctgagatcacgccactgcatctagcctgggcaacaagagactctgtcacaaaaaaaaaaaaaaaaaaaaagctgacttcataaattattagaatgaatgagaacatttttcccactaacattgcatgggtttcaaaccaatctttttggcgctaactttgtctaattactgttgtttaaaatgtaaaaatacaggctttctttctttgaaagtggctagacaaaacatctcaccatttcaatatttcctctatggatattacatgatataattgaagttactattaatatcctctggtgtgataatggtactgtgtttatgtaagaaaagtccttattcttttttaattttttttttttagacagtctcactttgtcacccaggctggagtgcagtggcacgatctcggctcactgcaacctctgcctcctgggttggagcaattctcctgcctcagcctcctgagtagctgagactacaggtgtgcaccagccaccacgcctggctaatttttgtatttttagtagagatgggtttctgccatgttggccaggctggtcttgaactcctgacctcaggtgatccacccacctcagcctcccagagtgctaggattacaggcatgagccaccgtgcctggccttttaatttttattttgagatggagtcttgctctggcacccaggctggaatgcaatggcatgatctcggctcactgtaacctctgcctcttgggctcaagtgattctcctgcctcaaccttctgagtagctgggattacaggcagacgccatcacgcctggctaatttttgtagagatgggatttcaacattttggccatgctggtctcgaactcctgacctcaagtgatccacccgcctcggcttctcaaaatcctgaggttacaggcatgagccactgtgcccagaaaaacagtccttattctttgaagatgcatgttaaagtatttacactgaagtctcacagtatttgcaaattataaatggctcagccaaaaatatgagatagcaaatatagcaaaatattgagtctacatagtagggtggtatacagatatttatttatactattctaattatatgtatctgagttattttgttttagagatggggatcttgctatattgcccagactgacttgaactcctgggcttaaacgatcctccagcctcagcctcccaagtagctgggactacaagtgcacacacagtgcctggcttgtatctgagatttttcttttttttcttttttttgagaaggagtctcgctctgtcgcccaggttggagtgcagtggcatgatctcggctcactgcaagctccgcctcccaggttcatgctattctcctgcctcagcctcagagtagctgggattacaggcacccgccaccaagcccagctaattttttgtatttttagtagagacagggttccaccgtgttagccaggatgttctcaatctcctgacctcgtgatccacccgcctcggcctcccaagtgctgaaagaaaaatttccagtccataactgttaaacaagaaacttaatattgccattattatgcaattcaatctgaattacccttatcaactaacttccaaaataaaataaagttttacctgcttttcgtaagtttggttttattcacaactatgtggcagctaaaataaagatctacagtcatatccatgttaaaggcctactactatattttaaccaataaatattactaccaacccagagtttgttctgcaatatcattaatcataatttgaagcagccctctcttgctatggacaagcttagacactttttatgtgactagaagttatatagtaatttagaaaatcataaaactgataaccaatttcctcaataacatttccaagtaataagccaaatttaggttaaagaatctataacaccttggccagatgtggtggctcacacctgtaatctcaggtaggagaggttctaaaacatggaagctttctgaaacctattgttcataatgccagggatcaggaacagtgatggagaaatttactgggttgaaattacaaaattatttgaaataattctcacaagggcctgtcccatccactaagccatactgtctctctagatgtattccacatgaaaaacaaaactgaaacaagacacgagggaactgtaagtttccatcaagtgaacaaatagatactctcactccacaggatagaatcagaagacattcttaactagctccccatattggacaagggccattaacatcttgactcaactctaccatccgtaacaacagcaaaaactgattcattcacagagtaggccaaagtctgacctcagcagggcaaacaaagcatttgaattattagataagcagattatgaacactggatagcattttaataattataccttcaggatgggcatggtggttcacacttgcaatcctagcacttcaggaggccaaagtaataggatcacttgagcctgggagttagagatcagcctgggcaatatagtgagaccctgtctctacaaaaacatttgtttaaaattatactttcacaatactccatctaattccagggatccatttctagaaatgaaaggataacaacacatcattactaatggcgtaagactgagacttttcctagttaacattaacacaggtttctgaatgtgaaatatttcactgccacattttaaaattccaaatgaaggtgttaaaaggttttctactttgaacttctaaaaaagccctagtaaaaattcataccaagaaggtaataaattgcagaatttatctagttttactgtgcatatttctctgcaaagagaataagattcaaaatgagattttatgtcataactctatcttcaattctgtattccctagaaggcaataccaggtatacatatggttgtgaaggccttttacattcacacacacacacacacacacacacacacacagaaaataagagttgcatgtataatgtctacatataaaatcagaatattcaagttggagagacttaaaatcatctaaaccaactccttatttgatagataaggacacagataacccaagaaggaagtgaaagccccaaggtctctgagccgcacagagccaaggacgaaagccctggacggtcctccaggcagtctcctttcctcccaacactctgcctctcctctaccaaccttcaaccaccgctgaactcccaaatcaggtcctctgagttaaaggttgagggtacaagctaaactatgaataaaaaaaaaaaagtttaactttttgttttcctttaatgctcaaggtaagtaattttatcacataagcccagtcccccagcaaagcagaacccgaaagacataagatattcacaaatggccaggcacggtggttcacgcctataatcccagcactttgggaggccaaggtgggtggatcacgaggtcaggagttcaagaccagcctggccaagatggagaaaccccgtctctactaaaaatacaaaaattagctgggcgtagtggcgagctcctgtaatcccagctactcgggaggctgacgaagagaattgcttgaatccaggaggcagaggttgcagtgagccaagattacgccactgcactccagactgggcaacagagcaagactcagtctcgaaaaaaaaaagatattcataaacaaaaattcacggtgttctccaggtggaaaaaaaacaagaaaaaaataaaatccacaatgtgggacagttcatgggagctaggcctatacaataatgctcccaaatatgtaaatgaaagaaaaaagcgaaacaacattcactgtgaaagacactgtacgtgatccaacccagtatccattctctccttcttactatcaaaaccccgattgtattcagggcagtcaaagagccttgtttcccagcctttcttgcaacgagacacttctagctcaggatgatcagggcaatgtgtagggagggacactcagaaaagttcctttggtcattggaggaggggaatagtctcagctagctcttagccttctgcctattcacccctttcttcctcccactgcatgaaacagtgacgtgatggcagaagcgatgcctttaagattaagtaatgcactgaagagggctgggaatacacactgcggcaatctggattccctgatgacatgaagcccgcccttatctgcctccctaacttaccatcacaactacattattccagaactgttactaccagccaactacaattcctaactgatctgtccagtaagcaattacatgctaaatacattcacatacatttcatataaaataacctcaaaacaaattataagtatttccttcctttttcggttgaggaaaccaaggcaaagagataacaaatccaatctgtgactgaagcctatagttattccactgtattttacttcttcaaatgtcacacatctgaaaaagtctatgattttttcttttcaagataaagggtcttgctctgttgcccaggctggtctgaaactcctggcctcggcccggcacagtggctcatgcctgtaatcccagcactttgggaggctgaggtgggtggatcacctgaggtcaggagttcgagaccagcctgaccaacatggagaaaccccttctctactaaaaatacaaaattagcccagtgtggtggcacatgcctgtaatcccagctactcaggaggctgaggcaggagaatcgcttgaacccaggaggcagaggctgcagtgagctgagatcacaccattgcactccgcctgggcaacaagagctaaactccgtctcaaaaaaaaaaaaagaaaaaagaaactcctggcctcgagtgattctcccacctcagcctcctgagtcgctgaaattacagtcatgagccacctgaaaaagcagaggcatttcaaaaaattatctcaatcattctcatataatgtgccacaaatccattcactgtcttctaattcattaaaaccctgccaaccatgattggatttcaacctgtgagtaaattctttaccaagagtcctcctctggctgactgataagtgatcacacctccagaaaagtatcaggtatggccctactggttgcagagtgtcagatcataaaaagctcagccccttctccatacagcagcccacataatcttggtcacaaacgccacgctctagtacatactagtacatatgtacttaacagtaacttatttacaacctgattctttaatcaagataacctaccaaccgcctcatacctcatgagtgccctcttgctcatctatctcctgtctctatgacattctgcttccaccaggaagccttctctgatagactcaactctgtgcttttccaaggccctattctcctttttaaaacgtacttctaaggatgcctaggctttttattcatacactatcttcataactccatgtaatggtcctattatttttatacagaataaaacagagacactaaaatgttaataatagaattcagtaacttttttaagaaacctattagaaatttaaaaatgtgggcaacttcgccaggtgcggtggctcatgcctgtaatcccagcactttgagaggcagaggggggtggatcacaaggtcaggaattcaagaccagcctggccaagatcgtgaaaccccgtctctactaaaaatacaaaaattagccgggcgtggtggtggactcctgtaatcccagctacttggggaggctgaggcagagaattgcttgaaccctggaggcagaggttgcagtgagccgagattgcgccactgcactccagcctggctgacagagcgagactccgtctcaaaaataaaaacacaacaaaaaaatgtgggcaacaaataaatggataaaatgtggtatgtaatacactatatatgaatactattcagccataaaaaaattaaaaccacatcttataattcccagcatcatggatgagtttaggggacattacgttaagtaaaataaagcaggcacgcaaagacatgtatcgcatattctcactcatacgtgggagctaaaaaagttaatttcatagaaatggagcagaatagtggttactagagtctggtggggaggtagccagagatcggttaacaaataccaaattacagatagataagagaaataagtcttagtgtgcattcgaaggtgaccataattaacaatttattgtagctgagcgcagtggctcacacctgtaattccagcactttgggaggcgggtcagttgagcccaggagtttaaaaccaacctgggcaacatggcgaaataccatctcaaaattaaaaaaaaaaaaaaaaaaaaaatttggctgggctcagtggctcacgcctgtaatcccaatactttgggaggctgaggcaggcggatcatgaggtctggggttcaagaccatcctggccaacacggtgaaaccctgtgcctactaaaaatacaaaaaagagccaggcatggtgacacgtgcctgtagtccacttgggaggctgaggcaggagaagtgcttcaactccagcctggcgacagagcaagtctctgtctcaaaaaaacaaaaataaaaacaaaaaacaaacacaacttatggccaggcacggtggctcatgcctgtaatcccagcactttgggaggccaaggcaggtggatcatttgaggtcaggagttcaagaccagcctcgccaacatggtgaaacctcgtctctactaaaaatacaaaaattagccgggtgtggtggcacacacctgtaatcccagctactcagaagcctgaggcagaagaattgcttgaactcgggaggtggaggttgcagtgagccgagattgcaccaatgcactccagcctgcgcgacaaagcgagactccgtctcaaaaataaataaataaataaaaacaaatattttgtcttttcaaataactagaagagtggattttggatgttcccaacacaaagaagtgataaataaggtgacagatatgcccaatttgatcattacacattgaatacatctatagaagtatcactgtatgccataaatatgtcaattaaaactaaatatatatatacatatataaagaggagaaaatcaacaatatggttaaacagaaaaaaggctctgcatattaaaaaagatacacaaatatgagttttacactttgttttaaaagacttgaattctagcattgaaatctagttttcttgcttgaaataaagataactgctttatgaatagaatattccaacaatgagtgcactgtcaattgcccagagtcaattaagtgcctgataagagtaacatttaggggccaggcacggtggctcacgcctgtaatcccagcactttgggaggccgaggcaggcggatcacctgaggtcgggagtttgagaccagcctgaacaacatggagaaaccccgtctctactaaaaatacaaaattagctggcgtggtggcacatgccggtaatcccagctacttggggggccgaggcaggagaatcacttgaatccaggaggcagaggttgcggtgagccaagatcgtgccattgcactccagcctgggcaacaagagtgaaactccatctcaaaaaaaaaaaaaaaaagaagagtaacatttaatgcaccatatcccgtagctcaagaactgaactgctatccagtatgtttccttctcctctccacacaaaaagagacactagcacatttcattacatctatgacacaccattattttatgacacaccaagaaagaaaaaagctgcccattagactatgacttatcaccattttaagacatctcaatttcaaagatgttaagatgtgggaaaaaaaggtctcagaatctataaaatacaagataaaccagacactgtttactgacataaaaacacttaccatcttcacacgccaccaatattccttcttagctaaatgtgtatttacatggtttactgaataattctatccagtctggttcaaatattatattaacacattgccaggcacagtggctgatgcctgtaatcccagcactttgggaggccaaggcgggctgatcacttgaggtcaggcgttcgagaccagcctggccaacatggtgaaactctgtctctactaaaacaacaaaattagccaggtgtggtggcaggccccttgtaatcccagctacttgagaggctgaggcagaagagtcacttgaacccaggaggtggaggttacagcgagccaagatcgcactgctgcactccagcctgggcgacaaagactccatctcaaaaaacaaaacaaaacaaaaaaaacggatatacaagaaactgtgctaggttacaattaaagcacatcctagactttatcataatatgacttctcttccaatatacatttgttaggagtagtagctctcaaacactctggtctcagcacgctttacactctgtatttttttttgcgatggggtttcgctcttgttgcccacgctgcagtgtaatggcacgatctcggctcactgcaacctctgcctcctgggttcaagtaattctcctgcctcagcctccggagtagctgggattacaggcatgcgccaccatgaccagctaattttgtatttttagtagagacgaggtttctccatgttgctcaagctggtctcaaactcccgacgacctcaggtgacctgcccaccttggcctcccaaagtgttgggattacaggcgtgagccacctcatgcggtctacattcttaaaaattaaagacctcggctgggcatggtgacttacgcctgtaatcccagtactttgggaggccaaggcgggtggatcacgaggtcaggtgttcaagaccagcctggccaacatggtgaaaacccatctctactaaaaataaaaaaaaattaacagctgggcacagtggctcacacctgtaatcccagcactttgggaggccgaggcgggtggatcacgaggttaggaaatcgagaccatcctggctaacacggtgaaaccccatctctactaaaaatacaaaaaattagccgggcatggtggtacgcgcctgtagtcccagctactccggaggctgaggcaggaaaattgcttaaagccaggaggcaggggttgcagtgagccgagatcgccccactgcactccagcctgggtgagagagcgagaccccgtctcacaaaaaaaaaaaaaaaaaaaaaaaacaaggccgggcacagtggctcacacctgcaatcccagcactttgggaggctgaggcaggtggatcacctgaggtcaggagttcaagaccagcctgaccaacatggtgaaacccaatctctattaaatacaaaaaattagctgggcgtggtggtgcatgcctgtagtcccagctacttgggaggctgaggcaggagaatcgcttgaacccaggaggcacaggttgcagcagtgagctgagattgtgccactgcactccagcctgggcaacaagagcaaaaccctgtctcaaaaagaaaaaaaaaaaattgccacgcgtggtggtatgcgcctgtaatcccagctactggagaggctgaggcaggagaattgcctgaacccaggaggcggaggttgcagtgagctgagatcacgccatggcactccagcctgggcaacagagtaagactctgtcttggggaaagaaaaaaaaaacctgaagacctcaaagagcttttctatgtgtgttatttaccattttagaaacacaaaatattaattcatttaaaagtaaatcttatgcatataaatataaatcatctttaagaaaaaaaaaactaatttccaaaacaaagaataacatagtaagaacagtttttaatcattttgcaactctctttaatatccagcttaagaaaagaaagctggattttcatatgtgcttctgtattgaatctggtatgttttgaatgtaattggaaaagagtactttaacagacttttcagataattctggacattttttgttgatataatgccaaaattgacaagcagttgtctcgtaaaggctaactgcaatgtggaatcttaaattgtaccaacgaacttttcatattcttatattaaaatccactgttctactttgctttttttttttttttttgagacggagtccagctctgtcacccaggctggagtgcagtggcacaatctcagctccgcctcccaggtttaagcgattctactcctcagcctccccagtaacagggattacaagcgcccgccaccacacccagctaatttttgtacttttagtagagatggggtttcactgtgttggccaagctagtctcaaactcctgaccacgtgatccgcctgcctcggcctcccaaagtgctgggattacaagtgtgagccactgcgcccagcccactttgcttttttttttggagatggagtctcgctcttgttgcccaggctggagtgcagtggcgcaatctcggctcactgcaagctccacctcccgggttcacaccattctcctgcctcagccccctgagtagctgggactacaggcgcccgccaccacgcccggctaattttttgtatttttagtagagatggggtttcactgtgttagccaggatggtctcaatctcctgacctcatgatccacccacctcggcctcccaaagtgctgggattataggcgtgaggcaccacgcccagcctactttgcatttttaatggatcttttaaccaggcataatttttctgtcatgcactggccatttggaaaacagttttcactgacttacacagatcttccaaatgttgacaccatttcatcatacatcaaaaatcctgtcagaggagatcgagaccacgctggctaacacagtgaaaccccgtctctactaaaaatacaaaaaattagccgggcgtggtggtgggcacctgtagtcccagctactcgggaggctgaggcagaagaattgcctgaacccggaaggcggaggttgcagtgagctaagatcacgccattgcactccagcctgggcgacagagcgagactccgtctcaaaaaaaaaaaaaaaaaaaaaaaagtcctgtcagaactgtctatctacatcagaaaactgttggctgggcaaaaagggcacataatgaatcaatattactatgaaaagttctgacctcacattccccttgaaagtatcttggggatccctagggggctccagacatcacctgtgccagaacctctgttacttaccaaaaacctaaagagtaaaattctgttcctctttcaccaagcacatgtccacaaacaaagaaaaacaaaagctatacttatgtgtatatacatttaaatataacactaaacttcaggttttgcatctgtaaaatgagattttaaatatctggtttaagtatctttcctattattctgaataactaagaaaaggccacatacttttatggaaggtgtgagctgctgaagtagttcttaagtcctcttttgtcacagaatacaggtgaaaggtaaaaataaacacaacataaaggtccttaatgaagtcctgagcaaactaagaagttgacagtatcaaatattaaggaaaaccccttttagaacttctaaatttgtaaggaggaactggaaacactttgcaacttataaaacagggtactaaaaagctccataatttggatgagtttaaggtattctattttacaaatgaagtaaagcaagtttcagctgtttctttccccaatgcacaaccttaatttccttttatcttaaacaccaggaatcaaacaatctcaaccatctgaaaacggcattgaataacctataaggtattagcatttaggaccatttaagaaaacaaacacacgttacatgtgggaaaatgaacactacataaaaaggcaaatgacatccacacagaaaagaattgaattccccatcattggaggaagattcaacactttcctgcaagatttccatatcgtttcaattgcaggtgccaaagtttagtctaaaaatgacctaaggacttggtgaaaacccagtagtatataatttattctaatccgtttaacaggtgtttgctgagcatctactacacaggcaaagctataagggacaaaagcttaggaaaccatagttagccccagatccactgtgataaggacttactctgatctcagcacctttaactgacctgtgtggtccagatttttaacccacaaaaagtgggccataacatctcaaagcaaaaatgctgcaaggataaacgtgaaatgtattagaatgaaaagtacattatagagcaatgacaagccaggcacagtcactcatgcctgtaatcccagcactttgcgaggccaaggtgggcagatcacttgagctcaggagtttgagaccaccctgggcaacatggtgaaaccctatctctactaaaattacaaaaattatccgggcattatagcacacgactgtactcctagctactcaggaggctgaggcaggaggaccgcttgagcctgggaggtggaggttgcagtgagccgagaaagcaccactgcactccagcctaggcaacacagaccgaccttgctttaaaaacaaaaaagaacaacaaaaacatgagctgaggccaggagtggtggctcacacctataatctcagcactttgggaggccaaggcgggtggatcacctgaggtcaggagttcaagaccagcctggccaatatggtgaaaccctgtctctactaaaactacaaaaattagtcgggcatggtcgtgggcacctgtaatcccagctactcaggagactgaggcaggagaatcgcttgaacctgggaggtagaggttgcaatgagccaagatcatgccactgcactccagcctgggcgacagagcaagactccgtctttaaaaaaaaaaaaaaaaaaaaaaaagctgaaataaaaacacatacaccaaaaatcatcaaggttttctcatttaaaggagtaatttcaactgcttagaaaattctgaagtggaaaatatatataaaaaaataaaataaaaattttaaaaaacagtcagggtggctcaccctgtaatcccagcactttgggaggccaaggtagccagatcacttgaggtcaggagttcaaaaacagacaggacaagaccccatttctacaaaaagtatatatatgtgtgtgtgtatatatatgtgtatatatatatatatgtgtgtgtgtgtatatatatgtgtatatatgtgtgtgtatatatatgtgtgtgtatatgtgtgtgtgtgtgtgtatatatatatatgcaccacaaaatagaggtgaaaggtaaaaataaacatatgtatatatagaggtatacatagaagcagaaatatatatagataaatatataacttttaaaaataaatttaaggctgggcatggtggctcacatctgtaatcccaccattatgggaggctgaggtgggcagatcacgaggtcaggagttcaagaccaacatggtgaaaccctgtatctactaaaaatacaaaaatttgctgggcgtggtagtgcatgcctgaatcccagctactcaggaggctgaggcaggagaatcgcttgaacccgagaggcgagggtcatagtgagctgacatcacaccactgcactccagcctgggcgacagagcgagactgtctcaaagaaaaaaaaaaaaaaaacagaaaagaaaatataactcaggtaattaaatacataaaactttgaaatgaaaacagcatgctgccattctatcctgacaaaagcttccataaatcaggcacttttacagcacttattctattctttaaattaacagggtaaatacaattctgacaccttaagaaaagatgcaatgccatctaatctattgttgtagagaggtaccagaacactgatattaaaatctactaagtcatttttatttttctttacgaatcttatattgataagcaggattaacagacattactaggctgttgttttaattctatttttcacacaacaaacatgactactagtaaaactgatgttaatcacagttgaaaagtagtatcctctcaactttcatctgtttttttctatcaataataacaaagttaccagagtttactctcctaatctgaagcggtacagtcaagcattaatgaagtgtacagtcaagcattattacttcttaagctactatttaaggcaacaaatgctattattgcctagagagaatatgattattaatttccacactaagagcccttatattcggaaagccaccattgctttgtaatactagtatttgcagtccaggttttctcgaagtataaaaacatgctaaaatctatgactctaatacctattaaaatttaactttaaataataagatgccatcagaacttcatcagaactgacaaaacactttaagaatgacatttaagaaataaaactgccagaactggcagactaaaaccatcatgttttatccaattcattcaagtgagtaatatgcccaatttaaaagcacacaagtcacaaactgatttctgattctacaaaaaatagaatttctaagccgggcacggtggctcacgcctgtaatcccagtactttgggaggccgaggcgggcagatcacgaggtcaggagatcgagaccatcctggctaacatggtgaaactccgtctctactaaaaatacaaaaaattagccgggcgtagtggcgggcgcctgtagtcccagctactcgggaggctgaggcaggagaatggcatgaacccaggaggcggagcttgcagtgagctgagattgcgccactgcactccagcctgggtgacacagccagactccatctcaaaaaaaaaaaaaaaatagaatttctaattctcattaagcaaataaaaagatacatatgtccattaagataatccagttcaggccacgtgcagtggcttgtgcctgtaatcctagcactttgggaggccaaggcaggtggatcacctgaggtcaggagttcgagaccagcctagagcctggccaacatggtgaaaccccgtctctactaggaaaaaaaaaaaaaaaaaaaaaaagttagccaggtgtggtggcaggcgcctgtaatcccagctacccaggaggctgaggcaggaaaatcgcttgaactggggagacagaggttgcagtgagccgagatcacgccactatactccagcctgggcaacaagtgtgaggctccatatcaaaataacaaacaaacaaacaacaacaacaaaaaaaacacacagacttgaaaacatacaatttatgggccaggtgtggtggtggctcgcgcctgtagtcccagcactctgggaggctgaggcggatggatcacgaggtcaggagatcgagaccatcctggccaacacagtgaaaccccgtctctacaaaaatacaaaaaaattagccgggcatggtggcaggcacctgtagccccagctactcggaaggctgaggcaggagaatggcgtgaacccaggaggcagagcttgcagtgagccgagatcacacaactgcacttcggcctgggcaacagagtgagactccatctcaaaacaaaaaaaagaaaaaagaaaaaacatacaatttatgaaaatgaaatgaaattacagtctttatgaaccacaaatacagtttttcagatatatcatggtttatatgttatatataaaactcttaactaaatctcaaacaagggaaaagtcacattaattactccaagagaaagaactggttactaactactttaatgcaggagctcgtggataaaaaagatgagtggataaaaaagcaagtgagtattcacaacagcatgacaaacaacacaggtatactcacatatatggcatttgataatcagagacagcactttagctgcctttcttcactgcctagagaaatgggcagcaatcaaggcattcaaaggtctacctcctttccttcttccaaccataaaaccaacctaactcaaaagaaaggtattttaaatctttatagataaaaatgaatagagtgacaaaatacatcatttgttttttctttattcattatcaagatggtggctatgaagaactaaatgaatcaggtttgtaaagttaacagatgctaataatgtcatattgtgatgcaaagatgagtgcttttatcctcagttcccttgataattgtgttatcaaacacatattgtgttcaatgttttagtgtgcttaagtacacttaagagcaacgttaatatctaatatcagccaccaagataaaaggctaaaactcctgtcaaaactactacacatactgaaaattcttttccctcctgttttcatctatttgaatataatttgtaataaaaatccatggccaggcacaatggttcacaactgtaatcccagcactttggaaggccaaggcaagaggattgcttgaactcaggagttcaagaacagcctgggcaacatggcaaaaccctgtctctacaaaaatatacaaaaattagctgggcatggtggcgtgtgactgtagttccagctactcagggggatgaggcgggattgctttgcacccaggaggtcaaggcttcagtgagccatgatggcaccactgcactccagcgtgggcaacagagagagagactgcctcattcaaaaaaaaaaaaaaaaaaaaaaaaaaaaggctggctcatgcttgcaatcccagcactttgaaaggccgaggcgggtggatcacctgaggtcaggagttcaaaaccaccctgaccaatatggagaaacccgtctctactaaaaatacaaaattagctgggcatggtggcacatgcctgtaatcccagctactcgataggctgagaattgtttgaacccgggaggcggaggttgtggtgagtcgagattacgccattgcactccagcctgggcgccaagagcaaaacttcgtctcaaaaaaaaaaaaacaaagccgacccaaactgtccaagattcccctcacaagattatgtacttgtaggcttagtttgatgtttttgtttttttgttttttttgtttttttttgagacagagtctcagtctgtcaccaggctggagtgcagtgatgcgatctcggctccctgcaacctccacctcctaggttcaagcaattctcctgcctcagcctcccgagcagctttgattacaggcgcctgccaccacacccaactaacttttgtatttttagtagagatggggcttcaccatgttggccaggctggtctcgaactcctgacctcaggtgatctatccgccttggcgtcccaaagtgctacgattacaggcatgagccaccacgcccggcctctagtttgaattaatgatctgatcaagtacaattcacagctgtgagaaccaaatgccatataaaagtgactgtttttttaatttttagagacagggtctcactatagtgctcaggtgggagaatgcagtgactattcacaggcacagtcattgtacactacagccttggactcaagcaatcctcctgcttcagccttcccagtagctgggactgaaggaatgagccactgcaaccagcgaaagtgagcatttgttacccagtttccttctttcggaatacaattaaaagagttatatagttccaagctttgctgccaaggagaatcactaatttatttacaggtttagattcaagaatagcaaaagggtagtaaacatccagcagtaagaccatgaaaacattatatccatctatatattactcttggtgatctcttactgatatgactttaaccaatcaaccttctacatacaaatgctacaatggaaatgtccaaccaaattctgaatttttaaattaatcaacttatcagcaactgtctatgcaacatagtcatcaaattgaaaagcaaaatccaggctgggcacggtggctcatgcctgtaatcccagcactttgggaggccaaagcaggtggatcacgaggtcaggagtttgagaccagcctggccaacatggtgaaaccccatctctactaaagatacaaaaaattagccgggcatggtggcgcgtgcctgtaatcccagctactcgggagcctgaggcaggagaatcgcttgaacctgagaggcggagattgcagtgagccgagatggagccactgcactccagactgggcgacaacatgagactccatctcaaaaaaaaaaagaaagaaagaaagaaagaaaagcaaaatccagattaccaaagttatactggcaccctttggacaaaacaactaaatttactttttgctaggctaagtgacagcccaattgcttctgaggtaacacaaaccagacacgcactctgtatctagttttctatttatattacctcaactaagattttataatccaaaaaaccttgaaaagtgtacatgataacttgatatatgaaaaaaagttgcctaatactaaaaaggaaatgcataattcacaacattaataacatgattttgtatgtagggagtatctcctaccttcacatataatgcttccctaaaaatggtttaaaagttagaaaccaggagattgaaccaaagacaaagattacattctcaattaattgatatcctaaatatggatcctccaagtgctacagaacaggtgccttttttgagtccactgacagacccgccaaccatgcctatcttctagagaatggcaaagtcttccagagaatggcaaagtccagccaagcctctcccttcacaagggctacctactcctctctctgacttctctgcagggacaggtcagaagatcagcagcaactattcacactgcctacataacgtcctagatacctacaaagcagggagaggcaaaaaggatcctccttccctcttaagcatatggctgccatgtagggcttccccaggctcttgaggatttgggttctactggtcatgggcagatacccccttgagcaccagcctataaacaaccagacaccttccccaagcatctggtgaggtacagagaagaaattacaataaccatagtacctgggcccccaaaagcttaattcttctccaatgtgatacccaattgagaatcactaatgcaacaacagcctctcaacagactactgtgttttcaaaagtttctacaatgcactcgaattacacttcagcatagaaaataacaaactggaatctttttttttggagacggagtcacagtctgttgcccaggctgtagtacaatggcaccatctcagctcactgcaacctccacctcccgggttcaagcaattctcctgcctcagcctcccaagtagccgggactacaggcgcaagccaccacgcccggctaattttttgtattttagtagagacagggtttcaccatgttgcccaggctggttggtctcgaactcctgagttcaagcaacgcccggctaattttttgtattttagtagagacagggtttcaccatgttgcccaggctggttggtctcgaactcctgagttcaagcaatgcccggctaattttttgtattttagtagagacagggtttcactatgttgcccaggctggttggtctcgaactcccgagttcaagcaatctgcccacctcagcctcccaaagtgctaggattacaggcatgagccactgcgtctggccaagacactggaatttatatgctcagggcaccattcctgtgtctgaataccaaaacagtctactcaccaaacatactatcattgctccaaactaaaacaggtacaagccaggtcacctttttgttagccaaactaaaagttccagctgtcagtaatattaattttttttgagacagggtctcactctgttgtccaggctggagtgcagtggcataatgatggcttgctgcaccctcaatctcctgagctcaagcactcctcccaaagtggtgagattacaagcatgagccactgaatccagctttaatttttttttagcaacacacatgtaaatgtccataagataaattgtttataatttatcagaaagaatgtaacaacaactattacaaatcaatgtctaattttattatggcagtgtccaataacctatcaaataactcttaagatgccaaaaaaaaattttaagcaccatttcactaaaaattaacttaaggccaggcacagtggctacccctgtaatcccaacactttgggaggccaaggcagccagaccgcttgagcccaggagttggagaccagtttggccaacatggcgcaaccctgtttctacgaaaaatacaaaagtaagccaggtgtggtggcacacgcctgtagtcccagctactcgggaggctgaagcaggaggattgagttcagaatccggaagttcgaggctgcagtgagctgtgatcacaccactgcactccagcctaggtgacagtgtgagactcggtctcaaaaaaaaaaaaaaaaaaaaaaaagcttcaaaaaattccaggctgggcgcggtggctcacacctgtaatcccagcactctgggaggccaaggcagggggatcacctctctactaaaaataaaaaattagccaggcgtggtggcacatgcctgtaatcccagctactcaggaggctgaggcaggagaatcgcttgaacctgggaggcagaggtcgcagtgagccgagatcatgccattgcactccagcctgggcaacaagagtgaaactccgtctctcacacacacaaaaattccaggaaagcatgatatcaaaggatatcctaactcttatagtctgtttcccattctgtcactgagctgctgttagttcctttcacctgagtttattccatgtgaaaattgaagatattattcagacttcaacagagtgctccagaaatatttatcaactgctgtaaacttcactagaaatgctaaagaaatgttaaaaaaaatcttatcaatactttacaaagaaaataataccatcaacaaaaagtgtgcttacctattcacaaagatatagagccttactagcaaatataaaaataaaattgctgtttgtgactatgatcctaaagtgtaatgtgtttttttttttgttttttgagatggagtcttgctctgttccccggggttggagtgcagtggcataatctcggctcaccacaacctccgactcccaggttcaagcaattctcctgcctcagcctcctgagtagctgggattacaggtgtgcaccaccacacccagctagtttttgcatttttagtagagatggggtttcgccatgttggccaggttggtcttgaactcttgacctcaggtgatctgcccacctcagcctcccaaagtgccaggattacaggcatgagccactatggccggccagattcctaaagtgtaatttcaaagggccacaaaacattttttttagacagggccttgccctgtcacccaggctggactgcagtggcatgatcttaactcaccacaacctctgcctcctgggcttaagtgatccttctgcctcagcccccagagtagctgggattacaagtgcatgccaccatacctggctaattttttatctgttttggtagaaataggcttttgccatgtagctcaggctaacaaaaatatttcacaataaaaatttaatttactaatttcaaatgggggtggggagagaagagtagctaccaaatcagctttaaccaaattcagctagaaatcaatgctttaggccaagcgccgggaggcagaggttgcagtgagttgaaatcgcaccactgcactctagcctgggcaacacagccagactccgtctaaaaacacaaacacaaaaacaaacaaaaaaccagattggccaggcatcgtggctcacacctgtaatcccagtacttgagaggcagaggcaggcggatcacctgaggtcaagagttcaagaccaacctggccaacatggcaaaaccctgtctctaactaaaaatacaaaaattagctgggtgtggtggcaggcccctgtaatcccagctactcgggagggtgaggcaggagaatcgcttgaactcaggaggcagaggttgcagagagccagtctgggcgacagagcgagactgattctgtctttaaaaaaggaagataaagtgtttaaatcattattcaagtgaaaggtatcacaatcattgtggtaaaatttgttttattgataaaaaaattaacaaaattcatatactataaaataaggttaataataaaaaataaatcagtgctttaagagcatgtaatttaacatgattcctttaaaatacacaagtgaggccaggcgctgtggctcatgcctgtaatcccagcactttgggaggccacggtgggcagatcatgaggtcaggagatcaagaccatcctcgctaacatggtgaaaccctgtcgctactaaaaatacaaaaaattagccaggcttggtggcgggtgcctgtagttccagctactcaggaggccgaggcaggagaatggcgtgaacccaggaggcggagctggcagtgagccgagatcgcgccactacactcagcctgggcgacagagcgaagactccgtctcaaaacaaaacaaaacaaaacaaaacacacaagtgaaacaaccgttgtcacaattttatttgggtgtgaaatatggaccatcatcagtaaacattaaattcaaactacgtgttaaacatggctgggcacagcggcttacatctgtaatcccagcactttgggaggccaaggccagaggatcacttaagcccaggaatttgagaccagcctggccaacagtgagacctcatctctacaaaaaaaataaaattagccaggcaagtggccacgactgcagtgagctgagatcacaccatgaactctcatctgggcaacagagtgaaatcctgtctcaaaacacacacgtgcgcatgcgctcaaaacacacacacacacacacacacacacacacacacacgcacgcacgcacgcgcatgcgcaaaccctaccacatgatctagcttagccaagagaaaaaaaagcgtatatccatacaatgttcatagcaactttactggtaatagcccaaaactggaaataacccaaatgccaccaagcattaagaggtgaatgcataaacaaattgtggtatatccacataatagaatactactcagcaataaaaaaaaaatgaactaaataacatgggtgaatctcagaattataagtgaaagaacccacacaaaaagagtatgtactgaatgattccgcttatatatacaattctagaaaatgtaaaataatctacagtgacagaaatgagatcaatggttggaagggagggagggaaagattacaaagggccacaagaaactttgggggaagataaatatgtctcctctcttgataaggataagcttcatgggtgatacataaaattaaaacttatcaaaagtatcactttaaatatgtacagttaactgtatgtcaattatacctcaataacaaaaaagaatccaagatgccaaaactaattctacagttcctgttagatctatctgctcataaatatatttaacctaccgacttgcagtatgcactctgagaatacaaaattatgcctaaattgaggatcaccattatcacaaaaaacatcaaagtttaaacaatgaggaaattagaattcatctttaatcactatgccaggctatttcagtgccaaaacgataccaactaaaacacaacacaacaaaacaagagcccgctgagtgtagggctctgagatttttaattaaatattttaattcaaatgtttaccttctttgatctagaatcccatttcgggaaaacagaaataacccaaagaaaagcctatgcacaaagatgttaatttcaatcttattcatcagagaaaaatggcaaagaattaaatcaatggcacagccatgggatggcatattacatgagctactttttttttttttgagactgagtttcgctcttgttgcctaggctggagtgcaatggcgcaatctcagctcaccgcaacctccacctcccaggttcaagcgaattgattctcctgcctcaacctcccaagtagctgggattacaggcatgcgccaccacgcccagctaattttgtattttttagtagagatggggtttcttcacgttagtcaagcaggtctcaaactcctgacctcaggtgatctgcccacctcagcctcccaaagtgctggatgtataggcatgagccactgtgcccagcctagtcattattatttttttttttttgagacgaagtctcactctgtggcccaggctggagcacagtggcgctatctctgctcactgcaagctccgcctcccgggttcacaccattctcctgcctcagcctcctgagtagctgggactacaggcgcccgccaccacgcccggctaatttttttttttttgtatttttagtagagatgggtttttaccatgttagccaggatggtctcaatctcctgacctcatgatttgtctgcctcaacctcccaaagtgttgggattacaggcgtgagccaccgcgcccggcccctagtcattatttttaactgggaaaaacagttgcaaaaatattaagcaaaaacagggcagacacatacagtatgatcaacaggttgaaaacaatacatcctggggagaataaaagatataggaaaaaagccataaggttaacatttaaggccaacagttcttaaacagtggtcctggaccagaagcatcatctgcgaacttcttagaccccaccctagacccaatgaattagaaaactccaggagtggtatgcagtaacctgttttaacaaactctccaggtgattatttgttttttgttttttgagatggaatcttgctctgtcccccgggctggagtgcagtggtgcaatctcaaactaaagtttgagaactactgtttaaagaactaggattacaggtgactggttttccttcttgtaacctatgtttttctcaattatctttttacttttgaaatccaactaagttcttttaagtattttactaacaggtacactctgtaggtctacaggtaaaaagctattacgttgcaaacattataacgtaatgtaaggtctggattacatgcctaaaaatccaatgattcttggaaccatcaaatctgttaagactgaaaagaataccaatgtttaaatatatctataaaatgcaggtcaaggggctaagaaaattgcaacactagaaaaccaacaaacttaggttgttctaacatacatacacaaatacaggagggacgtttatgggtcacatctgcgaaacattttttcccaaaaagctgaatttttaggcttgcgtgtaatttactagaactgcactgcaggaatcagatgttctgaagctgtgaatgcttactcatgtaggttcctgcctaaccaaaataagtaccagtatgttatatttgtcaccaaaatctaggcagggaagacaaattcagaacactgagagttgccaaatctttaacttttagcttgaagaccataaagctgtgccaactttcatctcatcatctcactaaaacagagtccactggaaataaagaggcaaaccacaggttcccaattgacactagaactagttaaaagatttagggaactgtctaccctttgaacacaaattaaagagtaacaaagactactaacttagggatagagtaactactgattaacagcaaaataccaaagttaagtcaaagacaaatggctacatattttaatattttagttttgaaatttttttaaacaggtgtacagatccccatatacatcctagcacacaaaattcattttaacctttctattccttgaaaagtccactctaagtaaatacaagttactcaaaaaggcactacacacagcaatgacctaacacagcctgtcctttccgactaaaaaagttttaactaattgcataagcaccatgaccacccatactgaatttttcactactaaactcccagcacaatgctggcacaaagcaagtacccaaacatatgaggattttttttttttgagataagagtcttgctctgtcgtccaggctggagtgcaatggtgtaatttaggctcaccacaacctccgcctcatgggttcaagctattctcgtgactcagcctcccaagtagctgggactacaagcccgcaccatcacgcctggctaattttttatatttttagtacaagtacatacggggttttgccatgttggccaggcttgtcccgaactcctgacctcaggtgatctgcccgccttggcctcccaaagtgctgggattacaggcataagccactgtgccagcttttttttttttttaattaagagagtcttgctctgttgcccaggcatgagtgcagtggcatgatcttagctcactggaccctcaaactcctacacttaggtgatcctcccgcctcagcctcccaaaatgctgggattacaggtgtgagccaccacacttggccacatctgaggttttgaatttgttagagaaagcttctgaaaccctaaagcagacaccaacgattctgtaaaattaactcaggccgttttaatgtaagacaccgtccctttctatcacacttgacgctttcttaagggaagctgacatttctgccatactttggaatccctgcaaatgagtcagttaagtgcatttaaagtggcatgccctgggccaggtgcactgggctcacacctgtaattccagcactctgggaggccaaggcaggaggaagatttgaggccaggagttgggaggccagcctggtaacctagtcagacctcggtctctacaaaaaatgtaaaaataaataagggggggatcctattactgaactccctctgaaaagaagaatcattgaaaactcttggtattgtaagttacaaaattgtacatatggtgtatgccggtccccattattatccgatctacttttctgatttaaccttaatttttctaaacatttcttgtactctaacaggtcaggttttcctcttctctttttacccctcgaaaacacacttgttcctgtaacaccactcagagggcctccccagcccccacctcttttgtatataaacacactctcttgtcacatactccatcagctgtttggtagctcctcccctcctccttttccgggtagtaacagggcggccaatgagcgctgaggagcggtgcctgcggccttttgcctgcatacgcttttccaaaacaagcagctctagccttcagcaggggccactggttcacagatgaaaggatcaccagggctgtgcaacagggtgagacgagtaacccccaccaacaaggaaacccgtgtaatctgagctgtttgttcctccaccagggagaacttaaaccgatattcctttagggcaaatcacgctttaaggtcaccagagccccagctctcagacaatctaaataatcagctggttggaggtggaaacctcaaaggttgccaggctctgggcagcacagatcaccaatctacctgactttgcaaacaaatggccgcactattcgagactattccataggatctgggctaactgcaaggtttttttactgggacacattcctaaaggatccaaaagtcatgtaaatcagtttctaggctcctggggaggtttgcacaacccttagcaaaggatcagaagagaaacaatgaatgagtcagagtttcagaacataatcacccagcagattattaagtgcattggtgcaaaacactcactccctgcataacttgggagtcagctctcctaccaacccgtcacaaaagaaatatcactgactccaaacaacaaccagagacggtgtctccaaaagaaccgagcgaggtggtggaaggcagcggccaattagttacacatcctcttctctccctacccccacactgctactttcctactatataggttccctgccaggctgtaaatcgtggtggtataattacgctcaggagacatccaaaaatgggctgaaacaggagactgcaaggaaaccagctatcgccccccacaccaaagaaatcatcaaggggcatggggggcaagaagtgcattccttcagaccttttcttcctacttcctctccaccatctttctcaacccccagccttttcacacaattgtactcattttagtagagggctggggaatttttccttaaattttctgctaaatataccttactcaaaaattgttggctccatttgggcctactgatctgtgaattcaacagagaaaggaggacacaaaatctctcacctacacaacacacacaaaaggaaatccgaaacattttaacttccaaactccattataccagaaaataaacacgaaacaaagataacctctggcttttaaatctcgaaactgttatcctcctatctcagatctacaattttaaagcgcctctgctttcttttgtcagaaaggaaggaaggtggggaaagaacagaaggccaatgcatctttgcctttcttcatcttctactaaaaataagctatgaaataagccacttagggggagaaaaaaaagacaccctgctgttctttgtctgttttcctctccctctccaccccccacaccccgactcctaaatgcggtaatcattctagatgccacaactactaaatgaacaaaaggcactgtatggaaaaggcatcaggtcaagttaggcccccctctttatcctcaatcttttaaaaatatgtctatgtacataatttgagactctgacaacgatcacaaacagctggaattgtctccccactccatcccaattaaacattaggtagaaattcgcattaggtgtgacagtaactctcaattcaagataaaaataactcagatgctgccactatgtcatttcctagtttctaaacaaaaataaaacccgaaactgctttgtgtaaaatgtacacacagtcatagttacaagttttcctgcagccttatgaaaagccaacattactggtatcattcacacatttacaaaacaatcacagccacaaacagctcataaagagttgatttcacttgcgcctgaacatatattgggtacactatactttattagttgctccgctctaatctcccactcccccaaaaattctaaactccaaaccacaaacttagaagtctatctactgctcctaatttctaaccaagttttccctgagcaaggagaaaaacaccttatttctgaaaagattattttttaaaaatctcttgcccagacaacttccctcccatcccccactgccaaaccatatgcaaaaactacttttttaaaacttcagcaaattccctaactgaattttttgacaataaccactgatctctacaaagaggtaaaacactcaatcaaaaacagcaacaaataaaaggaagaaaaaaggtattcacctgaagaatttagccaaacaacttgagttatataaacaaaaccctgcaacagggggaaacggtggggggatggggaggagggagagaaacaggagacaggacttttaaactgtgttccacactaccaccctctaagcccccacttgcccccctccccaaggactagctgttcagaactctgggctccccctaccctctaaactacccttcaaaaaaaaaaaattctcgatttgtcacaggaaccttcgcgaatttctctagctggtcctgaaataatcagtctggactccaaccaaaaccactgcctgaagggctcttatcagttatagctttcccactgcaacctccagagtgcataaagttggggggagggggcagaaaataaagggtgtcacttggcgacatcagggcaagtattcccccaagaacctgaccctcacagaggaagttttgcccaagtggccagtccagggactatttattttgtccaggagctcctctttccccagctgtcatacccacaatatggagggtggcttgctggagggcccgggggtcttcatcacatacaactatgggtgggacaggctttgtcagtggaaaggaaaacagtagggttctcccggggaccagaaagcttaacaggagggactgactgaaaacacacagagctctttcttagaagagggggccctgagcaggagactctcttcctaatatagaaaggaattagggataaaagaggtcgcttgagtgaccccagttcaagcagcattgtggttggaggaaatgggggcatctcaagaaacggagaaaggcttccctctcgggaatttctgccttgattccctaaatccaaagcgagcaaacaggagagagaaaccctgaaaatgggctcggtggtagagagtgaggcgactggtcgtgcaaaaagaaaaaaggccgtctcgggagtccaaacgtcgcggaggaaagtcacaggctctggggatacaggaagagcgagcagcaacgcgtatttcggggtgctgcggagaaaaggcgagctgaaaaggctctcggcccctgggaggtgccaaggagccgccgtaggcactgggggaggaggggagtctcggacagtggcctggagtgccccagggcccttgcagtggttccgggggtgccctgggcatccccacaccgccccccacacacagcccgaattcccctccacgaaggatacagcttgaccacgtccgtgtccatccgcctcttgcccggactgggagatgacatggtgtcgccgccgcctctctcccttcctcggcccgtctgtcacgggcccggggccccggctctgaggagcccgcggccgcgccggctcctcggtggaggtggcaacacccccgcggtcccggcggtcccgtcagccgccgccgccgccccccgcacgggggaacaccgggcactgtccggccgggtgggggtggggaccctgcggcgcccggctcgggctgcccctctccggctgtggttccgccgcggccctgccccggcgctcctctgcgccgcgcgacgctccctcctgcctgctgtggctcgctcgcctgctccccactcaccctctgaccggctcctagcagcctccactataagcggacgactcctgctcagtcggcctccctacccc

SEQ ID NO: 32 - DNA, 14324 bp, homo sapiens
ctagtgacactgggcccgcgattccttggagcgggttgatgacgtcagcgttcgaattccatggcggcgcggcggcgacggagcaccggcggcggcagggcgagaggttcggagctcaatatcgcgggacggcatgcggggggcgggcagtcagaaaggaacgatgccacctactgtgacccccttccccttccagctccctataacctgcacttggctaccaaaccagttggggtgctaaattttgtaaatttcggttttcagagctttggggattacataattgtgcataaagccttgcggagctgtaacaactaatgtgccagtactgttgttaatacctaatgtcatccaatttacaaaaagtaattgtaaggcacaccattattttatacacaacaaaggataagcactgaaaatggtgaactgtgattcactgcttatgtcatccattgtaagatgcatcccagttccagagagtaaaatgcgagtcttagacctattgagatacggtattatgtgtataatgttcttaaatgcataggtgcaccctataaattaggttctattgtacttctctagaagtacagtattgtacaatattctaatattggagtaagtgaagtaggaagagatcaaatacttctccaagtttccacagagaaaagcagcagagctaggctctaaattaggcacagacccttgagcacttaactaacctttatcccatacggcctcatgtatgaggtgggtatttgggggacattgggacacaagtaaaacagataagcaggcctcaatctatgagcttacaagactcctgggactcccttttattttgttttatttcatttggctagaatagcaatttaggaagaattacacagactgttacacaaaagtagtgtgggacagttgttattgcctctgtaaacttagaaaattatcttaaaccggcggggtgaggtggctcacgcctgtaatcccttgggaggccgaggagggcagatcacttgaggtcacgagttcgagaccagcctggccaacatggtgaaaccctgtctctactaaaaatacaaaaattaactgggcatggtggtgcacgcctgtaatcccagctactcaggaggctgaggcacgagaatcacttgaacccaggaggcggaggttgcagtgagccaagatcgcaccactgcagtccagcctgggcgagagagtgagactccacctcaaaacaaaaaaagagagaaaattatcttaaaccatttctttaaaagatttttttcaatctttaaaatctacacgtattcgggtgtgtactcattctttgctaatttccaaattctgtagcattaaatgaaagcaaaagagttaataatggcaacacggctccagaagactcttcccctgccaagaaaactcgtagatgccagagacaggagtcgaaaaagatgcctgtggctggaggaaaagctaataaggacaggacagaagacaagcaagatggtatgccaggaaggtcatgggccagcaaaagggtctctggtaggagtggatctggggatgatatcttgttatttcaactcctatttcgtccttctttcagggaataattaatttctctatcctttgggcataccacagcactaatctactgccttgaatcttcattttcatgtatttgagatggattggggtctaaggaaagaccaggattggttgggcgggcaaagttaatcctgacaagtttctgttttaccacaacagctgtttttgattcccataaagtagtacctatctgtctttcctcagaatctgtgaaggccttgctgttaaagggcaaagctcctgtggacccagagtgtacagccaaggtggggaaggtaagagactctggaaccgatcttcagtccatggatatctcagagagcatcctttgttataaggactcctgtctgggatgctgttagtactcattttaggaatcctctccaaaatatgatgagtgagtagttttctctaatggcaagagataggagtggtagggcttggggttaataatcagggtgttttttaacatggtgtgttagaccattcttgcattgctgtaaagaaatacctgagactaggtattttataagaaaagaggttcctagaggctgtacaggaagcatagcagtatctgctcctcaggagaccttaggaaacttttactcatggcagaaggtgaagcgggaataggcacgtcacatggcaaaagcaggggagagagagagagacagagagaaagggagagagagagattggagaaggtgtcacagagagagaaagagagaatggggaggtgtcacacgcttttaaactaccaaatcttgtgtgaattcactcactatcaagaggacagcagcaagacagtggtgctaaaccattcatgagaaatccacttccatgattgaatcacttcccaccaggccccacctccagtactgaggattacaattcagcatgagatttggaaggagacaaatatacaaactatatcacatgcgtaccttttgtggttgccatcagccttctacacctcattctctttttaaaccagaaaatggtatcattgttaagggaaaactgttttcttgttctaatgagaaactgtaccctggaatggcatgagttactgatgaatggggaaaaaagaaggctacctctggaataagttttctttaactcagttagaatcttttttttttttttttttttttttgagatagagtctcactcggtcacccaggctggagtgcagtggtgtgatctcagctcactgcatcctccacttcctaggttcaagtaattctcttgcctcagcctcccaagtagctgtgattacaggtgcccaccaccacgcccagcctgggctaatttttatatttttagtagagacggggcttcaccatgttggccaagctggtctcgaatgcctgacctcaagtgatctgcccaccttagcctcccgaaatgctgggattgcaggcatgagccaccatgcgcagcctaactcagaatcttttgtatagttaaaaaaaaggaagcatgttttcatttatagtaaggttacacccaggttactggtagaacataggtttgcaattctttccttgggagatgaatgttgatgttgctgtagaatgatgacttgagccataagaaaatttagagcctcatttaggatgtcagggctgaacctatactaatgttgattttttctctctctccctttctaggctcatgtgtattgtgaaggaaatgatgtctatgatgtcatgctaaatcaggtaagaggcaagaagaggtggcaccattatatttatgagaccatcttcttgataattattgatgatagcatcacagtgttcagatctttaaagtcccttttttttttttttttaaattttgttttttctttttgaaatggagtctcacttcatctctcaggctggaatacagtggcacaatctcggcttactgtaacctctgcctcccaggttcaagcaattctcctgcctcagcctcccaagtagctggggttacaggcgtgcaccaccactcccagctaattttttgtatttttagtagagacaaggtttcgccacgttagccagggtctggtctcgaactcgtgacttcaagtgatccacccacctcagcctcccaaaatgctgggattaccaggtgtaagccaccacgccttgcctaaagtccttcatatgtgtgtgtgtatatatatatatatatatatatatatatatatatatatatatttttttttttttttttttttttttttttttttttgagacagagtcttgctctgtcacccaggctggaatgcagtggtgcaatctcggctcactgcaatctctgcctcctgggttcaagcaattctccagcctcagcctcccaagtagctgggactacaggtgcagtgtctggctaattttttggtatttttagtagagatggggtttcaccatgttggccaggctggtcttgaacccctgacctcaggtgatccacccacctcaccctcccaaagtgttggtattacaggcatgagccactgcgcccggcaagtcctttatattaatattagccattagtggttaaacacctgagtactcagccctagcacactcttatcagatagcagagtcctctgtgagaagatttttttttgcaaatttcatatcatttattgaaattgttaactctctgttcatatccttttgcacattttttttttttttttaaacagacaggatcttgttctgtcacccaggctggagtgcagtttgtacagtcatagcccactgcaaccttgaacttctgggctccagcaatcctcccacctaagcttcctgagtagctcggacttcaggcgcatgccacaaagcctgactaatttttaaattttttatggagatgagaatctcgctatgttggataggtggtcttgaattcttggcctcaaatgatcctcctgccttgtcctcatgaggcactgggattacagggatgagccactgggacaagctgttttgcacattttctaaagttattggtccttttcttactggtttcgaggaactttatataatatggagaatagccttttgtctgtaatacaaaccacttgtgttttccagatttgtcatttaccttttggttttccttatagtacactttttgcccatattgaagttttaaattttttctgtagttaaatttattaatttttcctttttaaaaaattttgggtttttttttttttaattttagagacagtgtcttgctatgttgctcaggctggccttgaacttgtgacctcgtgtgatcctccaacctcagcctcccaagtagctgggactacaggcatctgcccccaagctcagctttctttttaatcaacctttttctcttgtttacctttgtggttttgagtagataatacatttgcctcattaatatatttcctggatatgacttcatgtttgaatttattgatccaacatatataattttaacaaccaattagtatttatttcttactatttcttctacttaaaataccacgagcagatagaaaataccttaaggttagccaggtgcagtggctcacgcctgtaatcccagcactttgggaggctgaggcgggcggatcacctgaggtcgggagttcaagaccagcctgaccaatgtggagaaatcccatctctactaaaaatacaaaattagccaggtgtggtggcatatgactgtaatcccagctactcgggaggttgaggcacgagaattgcttgaacctgggagacggagtttgtggtgagccgagatcgtaccattgtactccagccctgggcaacaagagcaaaactccttctcaaaaaaaaaaagaaaagaaggaaaataccttaaggcagccaggtgtggtggctcatgcctgtcatcctagcactttcggaggccaaggctggagaatcacttcaggtgtgagttcaagatcagcctgggcaacatggtgaaaccttgtctctacaaaaaaatacaaaaacaccgggcatgggccagctactttggaggctgaggtgggaggattgcttgagcctgggaggttgaggctacagtgagctgtgattgagccattgcactccagcctgggtgacagagggagaccctatctcaaaaaaataaaaaataaaaaccataaaaacatttacaaaaaaattttttaaaggaaaagaaaatatcaagctgggcatggtggcttatgcctaaaatcccagcactttgggaggccaaggcgggcagatcacttgagttaggggttcaagaccagccttgccaacatgttgaaactccatgtctactaaaaatacaaaaaaaaattagtctggcatggtggcgtgtgcctgtaatcccagctactagggaggctgaggcacaagaaattgcttgaacctaggacacagaggtggcaatgagcggaggttgcaccactgcactccagcctgggcgacagagcaagactctgtctcaaaaaaagaaaatatcttaggctcctttttgttctaacatctaatgaccttttttttttcaccagtgggctaaggtcgtacaatggctttagaatgtgagcaagcaggagatagaggtaggaaggggcagcatgcttaacaaaaaagaatgcctccatatccagggctcggccatacaacaccagctgctatgccttatcatggacttctctctcttcactctgagtgatttacttacagatacctctttttagatactggccatattctctctcagtatctccaagtcaggtcaggttaggtatgggacggatgtggcagtggttttgcgtatcccttgtcccctcccattattgccctgctctcagctcattgtcaaatttctgcagctgacaaacaaaagctgtgagtagaactgtcaaggagtaagtcatttaacagttgagcataacaggtttagacctttggagcatccaaattgttttcatttgggaaataattattgggagtggattgggagctggaaaacacatatagcttagaaaatatctaaatagggagctgaggcaggaaaaaactggaggagccattcaatgtaggatatttgaggttggatagagggttttaggaagcttctaggctcccactttaattcctaagaatccaaagtttaatgtataagccctatttcttctttatatctttaatcttacaggaatctaattttcttgcctgatgctatccttttccttatggaaataactggcacctgtgacgaaggatgagtcattggtttatgtgatttccatttgcaaaactccttttttttgtttttgttttcactcaacatagaccaatctccagttcaacaacaacaagtactatctgattcagctattagaagatgatgcccagaggaacttcagtgtttggatgagatggggccgaggtaatgatttttattgagattttatgagttggcattcagaaagtcagaagcagcttagtgggtggccaaaggattctctgggtttaaattgggtcagtagaggctctgaagtctgggagagccttaggaatcaagttgagcatcttgaaattggggaatggcaggcatcctccttagagttcccactggaaaaactaagagcagcccattgagtctgaaaactcttctatagttgaactgctagtagtgctcatagactatggcagttagcaagtaacttgtatcaacatgattagttccctaaatcctttcacctttcccttctccctttcctgcctgtttgtcagatgttaagcagagagatcttggagagctggcctgttactcttagggaactatcttatgtgtggcatttcctttgcagttgggaaaatgggacagcacagcctggtggcttgttcaggcaatctcaacaaggccaaggaaatctttcagaagaagtgagtgctgaaaagtgactacaaaaaaatataccctcctcttcttagatgtatattctctaaaaaatttttttttagacagtttcactcttgttgcccaggctggagtgcaatggcatgatctgagctcactgcaacctccacctcctgggtttaagtgattctcctgcctcagcctccctagtagctgggattacaggcgcccaccaccacgcccagctaatttttgtatttttaatagagatggggtttcgccatgttggccaggctggtctcgaacccctgacctcaggtgatccgcctgcctcagcctcccaaagtgcgggattacaggcgtgagccaccgtgccctgccttctctaagaattttataagtgtgtggcttataaaaaacttttcgttttataggtgtgatttggcctaaatgttaatgtcttttcaccctgacattctgtggttgaaacaccaaactgcatccttagtgattaaatcaaactaataccttgaaagtcactaaaaacagaagaatctaatatatttaacacatgactgacaaatttaggaaatttgggataagtggagactatcctgggatagataatattcaactaggggctgagcacggtgatgcctgtaatcccagcactttgggaggttgaggcaggaggattgcttgaagctaggagtttgagaccagcctgggcaacaaagcgagacccctgactctcccccaaaaaaaaggaaagaaaaaaagagaatattcagttagaatttttaaaactttatgatatagatgaagaactttctggagaattggagaacatgtttctttcagggaaagagattagatggatatcttttgtttgaaatctcaatggcttttgtggtgtttgggaaggacaagcattgtttttcccattttttaaattccatttgtctccagagcttttttgtccatttagtgtcctcatttagaattagactaattttgatttatggaaagttgatgtgtaaaggagctcagtgctggaaaataaattctttggagattttctgtcttgtaagtccatcttcatagtagacctttatttgtaaagttttcttacaccttggactctacagattccttgacaaaacgaaaaacaattgggaagatcgagaaaagtttgagaaggtgcctggaaaatatgatatgctacagatggactatgccaccaatactcaggtaactctcactatacttttcgaaagaaacacatcttctttttttattttattttttagaggcaaaactgtgctctgttgcccaggctgggtggcacaatcatggctcactgcagcctcaagatcctcaggctcaagtgatcctcccacctcagcctcctcagtatcaggaactacaggcacgtgccactctgcccagctgattttttttcttttttttttgtaaagatgaggtttcactatgttgcccaggctggtctcgaattcctgggctcaagcagtcctcttgtcttggcctcccaaagtcctgagattacaagcatgaggcaccacacctactcctgtttcttcttactcagggtaaagcagaatagcttagatcattcctggactgggacaggccaggatatcttgaatcctttctacttctcacctcaggggtgctctcactgatctttgtaatcccaaagggacagtaagaatgaggatagaatgtgcctttctagtcttggctctgttatttactaaggttcttttttttttttttgagctggagtttgattcttgttgcccaggttggagtgcaatggctcagtctcagctcgctgcaacctccagctcccgggttcaagcgattcttctgcctcagcctctcaggtagctgggattacaggtgcccgccactatgcccagctaattttttttgtatttttagtagagacagggtttcatcatgttggccagtctggtcttgaactcgtgaccttgggtgatctacccgcctcagcttcccaaagtgctgggattacaggcgtgagccatcacgcccggcctactaagtttcttataaaatcttaggccctatttccagacgtttattgtttttttcgtttttttgtttttgtttttttttgatacggagtctcgctctgtcgcccaggctggagtgcagtggcgcgatctcggctcactgcacgctccgcctctgggttcacgccattctcctgcctcagcctccggagtagctgggactacaggcgcccgccaccacgcccggctaatttttttttgtatttttagtagagacggggtttcaccatgttagccaggatggtctcgatctcctgacatcatgatccgcccgtcttggcctcccaaagtgctgggattacaagcgtgagccactgcggctggcaccagaagtttattgttatggaccaagagaggagtgataaaaaatcaaactgattaaacaattaacatttaaatttgttttcacttctggatatataccaccataaaaaatttaatttagataaactgaggtataccaggatgctgaaactgtccggaaacagtcacatatccaaaaaaatggagaagttttagtcttttttaagatgggaagatctgagacataatagctgtctttacacactgacgtcatgaggaaagccttttttttctagacttattctgagttgtaaaatgtgggaggcagaacttggatggtcaaccctctatatccatggattcaatgaactgagaatcaaaaatgtttgaaaaattgcttctgtactgaacctgtacagcctttttttccttgcttctcattattccctagacagtgcaatataaaaactttacaaagcatttacattgtataatattgggtgttataaggaatctagagatgatttcttagattgtcttgtgttttgtttgttttttgctataggatgaagaggaaacaaagaaagaggaatctcttaaatctcccttgaagccagagtcacagctagatcttcgggtacaggagttaataaagttgatctgtaatgttcaggccatggaagaaatgatgatggaaatgaagtataataccaagaaagccccacttggtaggacttcacattttcttctgcattctctccttataattcctagctcctttaatggatactttattatcattatgatttaaagcttgctcatagtactgaatgaagaaaatgggatttggggtgacaggttgtatggagggaagaggaactattttgaaagttgaggctgggtgtgatgggtcatgcctataatcccaacactttgggaggccaaggcaggtggattgcttgagcccaggagtttgaaaccagcctgggcaacatggtgagaccccatctctactaaaaatagaaaaattagccaggcatggtggtgtgtgcctgtgatctagctacttgcgaagctgaagtgggaggatcaccggagcccaggaggttgaactgcatttagctgtgtttgtgccacggcactcagcctgggcaacaggagtgagaccccatcttaaaaacaggaaaaaaaaaagttgaaagatgaaagtcttttttagggaaggatgttaagtacagttcactagatgggatcctagtttggagtctgatctctgggtgggcctgcagggaagctgacagtggcacaaatcaaggcaggttaccagtctcttaagaagattgaggattgtattcgggctggccagcatggacgagctctcatggaagcatgcaatgaattctacaccaggattccgcatgactttgggtaaggcctgtgctgttacttcactttgttcttctacctatacatatcccctgtatccatcagcagcagctataatcttttaaatcttttattcctaagaaaatgatcgtcttgaataggtacagaaacaaaatgatatataggtagcctatttaatcagcttacaaatatgggatgcaatctcccggcttgaccacagccatattctctgacaaagtggaagttaccaacccaagagagaatgggtctagctatccaaccacccaagtaaaacaccttcaggcatatcacccccttttcctatttgagtaactaaaaccacacaaacaccatttctgtgaactcaagtgatattagatagacaaaataacattttacatttgttgattctgttttctggtttacatccgatttctatttcttttatagctttatagagccccgtgacctagaaataaccctgagtggtcaacaggtctacctgtgcttctagatagaactgtatccaactgttccctgttgatatcaatataacttatttttaaatgattttataaaaaataattttaactctagtctcaaaagtcaaaatccacatagttcatcttataccgagtatatatttaatattattttatatatttggaagttaagatctctttacagatctctttctctctcaaatggaaaacctgtttctcatacctgttttctaaaggacctatctgtcattttctatttttagtcatgcgccttttagccacatgtcagaaagctcattatgggttatatctctgttcttagactccgtactcctccactaatccggacacagaaggaactgtcagaaaaaatacaattactagaggtgagatatgtatgatttgagaagtattatatcccttataccagtgtcctcccacattgattctatatctcatcttctcaggctttgggagacattgaaattgctattaagctggtgaaaacagagctacaaagcccagaacacccattggaccaacactatagaaacctacattgtgccttgcgcccccttgaccatgaaagttatgagttcaaagtaagaaaaatgatcatttattttcatattcttgcacccttaaccacctcccccatcccactgttctctaactacttcttgtcaagagcaaattgtcaattagggcagactttttatgtactagggatttgggaaggccaagcttttcctagctgccttgtaagactgtttgggagcagaaaggtctgccaagttatatcagaatccccaaattcttcagttcagctcagtctcttgtagagtctacatcagcctttttgtcttatttttcacaggtgatttcccagtacctacaatctacccatgctcccacacacagcgactataccatgaccttgctggatttgtttgaagtggagaaggatggtgagaaagaagccttcagagaggaccttcataacaggtctgagtctagctttgcgtttggaaagacactccttgcccgaaagtacagctgtagaacttataagagggagtcagaggaaggtgttggcttttttatgcttatggcctatctgtgcagaacaacagagtacaataatattggcttttccttaggatgcttctatggcatggttccaggatgagtaactgggtgggaatcttgagccatgggcttcgaattgccccacctgaagctcccatcacaggttacatggtgagtgaaattgaactctgggaggagcacaggggaaagggatacagtaatgttctcagtgctttttttcctagattaggattagatggttcccctccccaagagttaagccagctcactgataaccttgtcatctcttactgtgtccctctttctttaaattcctaaagatacctcacctttccctcagaaggcggaaattcacaggggcttctaccctctctagaacagaattgtgaggggaaatggagaagggtctatattgtgtttaagggaatggaaaaacagggtcagtggtatgcaccttctctctaacacagtgggttagaagctgaccttggtattcatgtatatatttcagtttgggaaaggaatctactttgctgacatgtcttccaagagtgccaattactgctttgcctctcgcctaaagaatacaggactgctgctcttatcagaggtgagacaggagtatgtctgtgatctctagtttattaattccagtttttttccgatgagaaaagtttgaccccagaaccaagaggtttacctgggatagcttgagagaggaccaagtacaatttctagtacattggattcctctgctggagtaggggaaaaaagtactgatgggattttctgtttggctttggagccatctaattcttagtaggatatgggaattcaaaggttttttgctttgcaggtagctctaggtcagtgtaatgaactactagaggccaatcctaaggccgaaggattgcttcaaggtaaacatagcaccaaggggctgggcaagatggctcccagttctgcccacttcgtcaccctgtaagtactcagaaccaggaggactagaagactccttttggccagataagactacgttctctattgcagcttctgaaccagagactgatgttgacacactttttttccatttggcaggaatgggagtacagtgccattaggaccagcaagtgacacaggaattctgaatccagatggttataccctcaactacaatgaatatattgtatataaccccaaccaggtccgtatgcggtaccttttaaaggttcagtttaatttccttcagctgtggtgaatgttgatattaaataaaccagagatctgatcttcaagcaagaaaataagcagtgttgtacttgtgaattttgtgatattttatgtaataaaaactgtacaggtctac

SEQ ID NO: 33 - DNA, 5220 bp, homo sapiens
caagctacagccttaaaatctgagctcctcaagtgcacaatttctgtcccttttaagggctcacaacactaaagatttcacatgaaagggtcgtgattgattgagcaatctaggggatatgtgacaggggtttcatgcactggtacagaacacaacagggagtttcacaatttttttatacaatgcttggaatctacggataacatcaggttctaagtcgtaagttgatttttaactactaggtttaggccaggcaggcccagggctggtttcaggcctggtgccgggctgcctgtctttgatttcacttccttgtttttttcttaaaacaggtactgagtataaaacaatataaaacaatatgagaaggtctctctcttccctcaagagtgtatgactttgctgcccaggatgatcttgaactcctggcctcaagctattaatttcttcccaactcagcctcccaaagtgctgggattacaggcatgaaccacagcgcccagcttaacaggatttttcagagagaaaaagttttttaattttaatgaaatccaccaatttatctattttttcttttacggcatgtgcttttggtgtaatgtctaaaaactatacctacgcctaggttgtaaagatagtctgttttcagttttatagctttccattttacatttagatatatgatccattttgagttaagtttgtattacatgtaaggttggggttcctttgttttggtctttgacaaatggaagtccacaacatttattgaaactcttcttcctccattggttttaagataaatccgttggccatacttctgaatgtctatttatggattccctatcttattttattgatgtgtatttttgtctctcctccatggatacatgaaggaaagggccttggacacaaggcagtggggaaaggggctggggggccacacagagaaaggagaaggcactaagatcaggctcagcagcttctggatctgaggcgccggagattatttatgggtcaatctggcagcccctgggcctcaggtaggactgcttagcagtgaaaagggcgtcctgggtgcagccaacagggtacagctgcaagccattgttgaaggtgtcttgacgtatcagagaaggcaggtaaccaggccacatccctgggcgcccgcgctgtcccactcccttcctggtgcgccccgcctcgcggtcacaagggccccaccgcccggggagagctgcccaccccgcgcctgacgcccagggcctggaatcgcgctgcaaccgcggcctctttccctggttctggccaggtgagcgaggcctagcaatctctcccgcatcacaaaggattgggtcagttaaggctcatccgaaagcatctgttgagcccctgggaacagcttagccaaatactgactgcagctacacgttaggaaacactggtacaaaccaacaggcagcctttccgcccttgcggagggagagactagcatcatcatcaagagataaaccgaagtgtgctggaaaacacacgagctctttagtaagagcaggcgacatgcaaggaaccatagtaacaggaacagaggtcctgaggctggatatggaacccaagtttgaggatgaccaactgagaccagtgttgctggagcacaaagtgccaaggagagaaatggcaggctaaggctggaatatgcaggtatgaagcgcaacctgggttcttctgtgccatgtgaaaggttctgctcttgatcctacggaaagtgggcaaccaaaccaattgttttccaaagatcctaaacaatgtaaagctaggctttgatcaaagggctaattaacccatacttactatttgttaacaggagtttcttacatcagatttaaagcagaaggctcacagcttcatttcaaccatgccactgtatccatgaaaactctgaaacaagtatttgtggacagcaaaatccacatgtactcaatacctagcttaaattatcaaaacacaaccaatcttgtctctacactaaaccacttcatttgctgactagtctttgaagacatgaaggtctctgacaacctcatgagaagatactgaaaacatcagtcttgtcgtataccttatctcccttgcctggcatatacttccatcaactaaatgatccaatgcctgtattctcctaaacacattaatgtagacacattacaacacagatcctgacacctttaaataataaacagagtggggagcaattttgagtttactatttatcatcttgggcccctgtaagatggatacaagaatgtgcatttccaagggtacctaagataatctatgtgcaatgaaatttggtaactgaagtgttgcacccgatatggaaaataccaagaataaaaaagaaagtatctcactagaatttcagtgagtttttgaagttcccttaaagttcttaaagtaatactacaatactgcacatttattccagatctatcccattttcttattccacaggatgagggaaactgtgccaggttacaaatgttattaactctagagaatcctgaaacaaccctgtcttattgtctcctaaaattggtacaggtcctgcgtttgctggtttaggataaaaaaaataagggggggtggtggtggtaatgaacatgatcttcgtggtgagaacaggggacagtaagatacaaacattttttggcatatgaaaatttattactacagtgttttcaccattaatatttatgatcttggtctttccttcttgcctttgtatagggccaaaagagaaacattggctactttgacaaccttaaagcggactccaggaatatcaccaacagcatgacctttgcgaccaaatccagcaaccagaacttcatcattttcctggaataaaataagaagtttatttctggtgttggtggcgatcacaaaaatactttcatgtgaggaaactcccttgcatcagataaaaatgtgagggaggccaccccaagaacagaaggtacgatagagttgaaatactcacctcaataaagttcaagcaaccgtcattgggtacaaaggctgtgattttcttgccattcttgatcagctggacccttacacacttcctaatggcagaatttggctgtttggcttcaactcctctgaaatacaaaaggcacagcactgtgagctggctttctgaaaaagattatcttttcatattaactagagaactaatgagaaactgtttctatcttttcaatctaacctcaaatggctgagctgaagtcctgtgatgtcaacctagttttctgccagtcttaatttcattagcacaatgggggaaatttctagaccttttacagttataaaagtagactggagtggcagcgtgggcctgtagtcccaactacttgcgaggctgacgtgggaggatctatgcctagaacgtcaagatggccagcctgtgtgacaagggaccctatctcaaaaaaaaaaaaagaaaaaagaaaaaaggtatctgaggtaagaattagaaagtctgggccggacacagtggctcacgcctgtaattccagcactttcggaggccgaagcaggcattatcacctgaggtcaggagtttgagactagcctggtcaacatggtgaaaccccatcactactgaaaatacaaaatattagctggtgtggtagtgggcgcctgtaatcccagctacctgggaggctgaggcaggagaaatgcttgaacctgggaggctaaggttgcagggagtcttgcgctactgcacaccagcctgggtgacagagctagactgtctcaaaaaaaaaaaaaaaaaaaaaaaaagtctgggttaaaatggctctaccatcaaatatgatagaactatatgaaattattattttaaaaagtcaaaaccagtcaaatactggcagtttcatgtctcaatcttaggtgtatgacctcaattaattctgatgcaagtcacttctcttcaccttagttttatcaagtcgataaagttcaatagctgacacgtgccatttacttataacaactcccacagtaaaggtgtttgtgtcctttacttcatcattgctagtatcttctccaattccttccaggccaacgttaaattaaaaccttaactacctaattcccaaaaactaattttaccaacttttaaatagaacaaacgctttgcaattttaccccacaatgcccaaatgaatactactacacaaaaacctgcaattactttcaaaacaagaattcgtaagttcatgtctcgaattcctataataaactaaaacttgacgggagcaatggacttacactttttccagcacgattccttttgcatgagaagcacctccaaaagggttggcctttagggctgtgcccaaatgagctttcttatactgtttatcatgccacttctggtctcgtcggtgactacggagcttcctagcagtacgaagtccacgacacttgcctaaaaattaaatattttagttcttccgtaaaaacacgccatctacgtgtttcccatcttctaagacactcgcctcacctggaataaacccttaagccgattggctctcgtactatttattggcctgtgggccaaacatttggccttcaagttgccctgaaccgactaataaacgttcgaagagggctccggagaatgtgttctcccgaaggacgaggccccgctcgaatgcccgggaggaagcgctggcctccctgcgtccctcggtaccccgacctcggcggcctccacgcctcatgggccccttccgcgccggaccacgtgcctcctggagcggcgcttccccggccctcccccatggagcctctccatggcatcccccgccctactctattcgcatccgcccgcccgtccccaagaccccaagtcccgcttgcagcgcccttaaaccggccacaacagctcacccatcctgtcggcgccacgggcctgagcgaaagagagaagcaccgcaggaaggagccacaagccaccgcgagcaagccccgcccagccaaggaccccgcgccgctgtctgcgccgcgcctgacccgaggctggggtctctcctttgaaaacgacgcgtttgcatcactttcctgagccagaatctgcgtcttatttaatttgcaagaaattcagagatatctaatttgcatggttttttttccccctttttcttttga

SEQ ID NO: 34 - DNA, 131569 bp, homo sapiens
tcggccgagcccagagacagccagttcctctcccgccgcgccgggccgcgctgccgctcgctccccggccgtggcgcctccgggccagacgcgctgcagcctccagcccgcggcaagcggggcggccgcgccacccccggccccgcgccagcagcccctcgccgcgcgtccagcgttcccggccagcagcctccccatacgcaggtcctgctgggccgccccgtcgcgccccccactctgaactcaagtcaccgtggagctccgccgccccgaaactttcaccgcgagcgggtgagtcctctgcgcgagcccaggggtgggcgcgggcacgcgggcagtgggtgcaggggccgcggctgtgccaccagccggagtcccgggcgcagggtagactcggggccgggggcatcggcgcggcccgcggcggcttcctggccgcaccgcctctgggctccggcggcgaaggctcttagatgtcttcagccgacgggtgaccgggcccgggggagccagggcgcggggactgaggctccgcaggtgtccgccgcggagccgcgcaggggagcggtgggaggtgcgggcgcgggggcgggctcaccgcgtgtccttcccggtgagggcccgagggccggctgctgtccctgctccggccgcttctcgcacacagtggggaagccgctgcccttgcggagcgggcgcgcggcggggatactggagaggactcctcggattgtgcaatctgatctcccctctggaccctgggtctcctggcagtgggagatggggctcggccggcgccctctcgaggcccgcggacagttgccctccctggtggccccgggcaggagcgtgacgtcgaggggctgcagcggaggctggaactcaccctcccgctgcggcgcctctcggcctgccgaggagcagtccggtgcttttgccggctgagaggaagcgagagttattttaagaattcaggggttgcctttccttcgccttgggggaagggcgtaagagtcagttcccactttcctgcattctctgggcccatggtggcatcttttgcttgcggtgcattcgtaactttccaacagcctgcctgtcatgtggattagcggttgtgtttttgtatatccgagtgtgttaattatcccaaattcgcccttcttcgccagctcagaatctaggccttgcacttttctggctgtatatttaggggaccgattattgaaattccctgtttgagtttcttcatctttgagagagcatatatacctcaggggctgtttagtacacacaaagcccctagtacgtaccaagcatttcataaacgatgttactgttatttattgcagtgaattctattcatataaatgaggcttcttggttctttgcagcttggtgatgttgaagctaagactaccatgtcagatttagccatctgaccttattagtaaatctgcttaataaatacatgagggatttgctgtcccaaagcagggcccagtagtctgactttccctaaagaactagccaataaactggtgggctacagggatgttttctctgtacagccaacacctaaagccatgccctggggaataggcactgcaagaacccaggccttactaagcccttctctgtaagagtaagctttgttgggaaagggtgggatccagttagtccctccattctcatttggaggtaagcaggtaagcgctttgaggcctgaataaatttcactggatcatagagtctttggtgactgggcctctttggatgtaaatgtgtggcccttttgctgagtgaaggatagagggcagcagatgtaaggggagagaaagtaggagccaggaaccttgagttttggcctcttccatcatttaatatgctgtgatttgggataagccacttgggccatttattcagccaagatttcctttatagcagcagccagagttatattgatttgtctgcaggttgatagtctgtattaaccattacagtggaagctccatgaaaactgcttcatctgtcttgtccaaaatgatagccccagtgcctggtacatagtaggtgctcagttcgagattacttggaagaaggaatgaaggcctcctgtgagcttgccctatgcaaaactgaggacatagggagatgaagaaatagagctggtccctaaggtgtttgaagcctactggccctttctgttgtggtttctaaaacggggatttgagaggctttgttgactgtaaagttacccagcactgagttacccacatttagtgtgggtaactaaatgagagtctccactcagcaccgctcttctctacttattactggaagagaggtcctgatgtggggtggttaagatgtttcctgcaaaggtagttggcccaatccagaagacctacattattttagagtcattggtgttacaaaggtaggtcgaaactttgtaatcccgcccctgccctccaatagctttcttttagcagaaaagtggtccagcactgttcaatgactttgaaagccttttacttctatctgcaatatttgtttttagataaatcaccaaaaacatctgagattccagttggttcacatgactatgtggagttgtaacttaacaaaattaaatcatattattcatgtacaaacccatactaactttataaataaggacaccatgtatacatgcccacagcagggaacattgttataagctcactcctactgatgatctcagtgatgcatggatgagtgttaacattgaaaggccaccacaatcattagtcaggacattgatcaatgtcacattgatagcagagatagcctcagacctttactggctcttcctagtgatgatggtgaaggtgttagcacctttcatttgttcagggctctgaagtcttcctgaactctaatttcatttgaacctcttgtggctcctataggatggagagggacagatacagaaaaagattcagggggttgtctaaggtcacaggcttggttaagcggtaccattaggagtagtaggtatgttttttggctctttctacttgtccacctttggacttgtagtgtgtgctcaattacaaatgcctctcaacttatgatgaggctgtgtcccaataaacccaatcgtaagttgaaaatactgaaagtagaagatgcatttaatacacttaacctactaaacattatagattagcctaacctaccttaaacatggtcgaaacactcacattagcctactgttggacaaaatcatctgacacaaagcccatttgataataaagtgttgaatagctcatgtaatttattgaatactgtattaaaagtgaaaaatgaaatggttgtatgggtacttgaagtacagtttttattgaatgcctaatgcttttgcaccatcgtaaagttgaaaaatcattaagttgcagaccatctgtgcttaaaagcaaataaataggtcatttaacaaacattttaaaagtgaaatcatgagttaattttcttttatcacttggtaattgtctgaactaagtggctaactgctcaggacatagcagatgcaccatcaagctgggcacttcaagctgtcttctagaaatgaatttctgtgctttttagcactgctttttgcttgggggtgggaaagggtggtctccagtaactgctaagatgacacctatactggctgctgtccgagcagccctagtgactgtcttgggggcaatcagttgcttaatggttaatacagaagtacctgagtaatactttgcaaaaggactttccccgacctgtgctgggagtgtctccctgtaaactttgccaacctcctggttgttttatcagtgagagcatcatttaagtgaaaatataaattaaggagacagggctcataggacgcacattaaaacacctgatcattttgagcacctgctgtgtgcaaggcactgttctaggccaacagtatagatatacattgcctcccatcttttaaggctgataatgaagagaagaacatggaagaggaagttgttgggttttttttttccagtcagaaatactgaaagatttcttacagctgtctggtttcctgatacttaaattgtgaaactttaagttcactccattatcatttctaaaatttattttgaataagttccctttcgggggagatacccatgtgtagagaatggtatggaaatctgccaatggagggattagaaattttgtcagtttaaagacttggaccttttgagatttttgttgttgttgttttgtttgttcttcttttctgagatgaaggctcactctgtcgcccagcctggagtgcagtggtgcaatctcagctcacggcaatctccgcctcctgggttcaagcaatcctccctgcctcagccttctgagtagttgggattacttacaagcatgtgccaccacacccagctaatttttgtatttcctgtagaaatggggtttcatcatgttggccaggctggtcttgaactcctgaccccaagtgatctgcccgtctcgtcctcacaaaatgctgggattacaggtgtgagccactgcgcctggcctttctggggtatatttggcttaagttagttggaagggctctctttattttttattctgcctcccactgaagagacagagttcgctcttgtcacccaggctggagtgctttggcgtgatcccagttcactgcacctccatctcctggattcaagtgattctcctgcctcagcctccctagtagctgtgattacaggcgcccgccaccatgcctggctaatttttgtatttttagtagagatgggtttcaccatgttggccagggtggtcttgaactcctgaccttaggtgagcccgcctcggcctcccaaaatgctgggattacaggtgtgagccaccgtgcctggccctgtcttgtaatttagaagagcaagtttaaatacttgggatgatgtattaaaaagcctcatccatgctgacaagagcagggcctgtagtagcctttgttgtttatccccttcatcctgttctgtacttcattttctctcattactgaattagctggcagcattccttatttgccacagagctatttcttaaaagctgtacttacactcaggatacagttttccttggtatagaactcttccatggcattgctctttcactgagctttattaaccctcaggcttccagtaccccttcttctgctctccccacttcattccctatcatcttacaaaggcttcttcaaccaggaattggcatgagctgaccgtgtatgggaagagattgtcagttaacctcattattgtaaatgctcagtgttcagaatgctgctacttaaatgacatcctatagaactgcatgaatcgggatacatttaaataatccagttaagtggctgtttcttgatggttgaggctctgcttttgggttgtagaacactgggaagaagtcttcacagctcagatagttttttagttggtctcatttcctttctacagtccatgcttcaggcaaagttacatattgcctgcctgcccacacctttctgtgagcatctgaaatcttgctcactcctctttattgacaccagaccatactggttggaagcttctttccagtccccgctttcctccctccattggtaaaacatctggtggggaggtcttcgtgtggtctttgggcctacccttgggcgctggtacagtgagactggagagatgggtgtgtattcattctgcctcccactgaagcaatgacgtcttcttggtgtttgggtctctgggtgcccccactcttcctgtaaatgttaacccccacggaggtgaggggaatggagaagcttatctcagagaggctctctggagagggaggaccacttctgctttccagggggaagctgtgtcacggagagcagaactgtagcccgatgctggagagaaaaggccccagaggaggcaggcaaggaagtgatacttcctccaccccaggcccctgggtcatttgcctgcagccccaccttccttaccacccaatgctgcgttttcctcggggttctttctaccctctgctgccctctgcattttcggtttgcccttaagtgaggggtggggcggggtgggagagaggagcagtctagagtcttaagggcagagcctgctttgcgaagcccaccctggccatgcctgactttttcagcaacggaaaaatgtacattttgaaattccccgtcatggaaagtgttatgaaactcttgggtagacgtttcgaaatcttttaatgttcaggctacataataatttttaaatactaactataataattcaggactattttaaaaattgttaaattccttgttaaattcttgggatagaacagtggctgtcaaacatctttttttttttttttttgagatggagtctcgctctgtcgcccaggctgtagtacaatggtgcaatctccactcactgcaacccctcctcccaggttcaagcgattctgctgcctcagcctcccgagtagctgggattacaggcatgcaccaatgcaccaccatgcccggctaatttttgtatttttagtagagacagggtttcatcatgttggccagcctggtctcgaacacctgacctcaggtgatctgcctgcctcggcctcccaaagtgctgggattacaggcatgagccacgcgcccagcctgtcaaacttatttgaccacaacccatagcaagaaacattttaccttgtgctcaaatacacatatctgtaggcaaaacaaaatagaaaaaggaaaatacaatctggtggaacagcccctccccttaacttgcaggggaatgtggcctggagcagcttttctgaggtaggattggccagctccatcagagtttgtttgttctgatgcataatagatatacatagtttcagggcacatgtgataatttaatacatcatataatttgtaaagattaaatcagtatttgcgatagccatcaccttaaatatttgttttctttttaaatgctgaatcttttgaattcttctagctgttttgaaatgcacaatagttaatggtgaactctagtcaccctaccaggtcttatttcttctatcaaacagtatatttgtatccattaatcaacatattttcatccccccttccaacgtacagagatgggcagtccaatagggaggtttattaaacaaacacaaattaagtcacattcatataatgggatactttgtaaatatcttaaaagataaaacattcaattacagttactaatatgaaaaattttttttcaaaagctgaacacggccaggcggccaggcgcagtggcccttgcctgtaatcccagcactctgggagcatgaggcaggaggattgcttgagctcaggagctcgaaatcagcctgtgcaatttgtctcaaacaaacaaacaatagcaaaagagctgaacacaaactagtagatgacatgataccatttctgaaataaaatattcatatatggacacatcatctataaactgcatttcaaacaatttttatactaagatcttaatagtgattatttctgggtgacagttgagtgctgtttttacttctgtacgtctttatatttaaaagaatgagcatcccatatatacataaatatatatataaatcccacatataaatatatacataaatcccatataaaaatataaatatatatatatatatatacacacacacacacacacacacacacacatatatatatattttttttttcctgagacagagtcttgctctgtcacccaggctggactgtgatggtgtgatctcggctcactgcaacctccacctcccgggttcaagtgattcctgtgcttcagcctcctgagtagctggaattacaggcacacaccaccatgcccagctactttttgtatttttagtacagacagggctttgctgtgttggccaggctggtctcgaacttctggcctcaagttatccggctgcctcagcctcccgaaatccggggattacaggcataagtcattgcgcctggctccttatatgattttaaaacggcaggatataaggagcaatggaatgaagccagtgggactgcagaaggcaggtggaagcagacagggaactttggagctagagtgacttgaaggacgcttgatggatataattgtaagagtcctgtctcaggagagctgatgcgctgtaaatgttgtaaatagaacattttcttaaagaaccttccactgctatgtttagtattcagtttagcaaacttttcctgggtagctactgggagtcccgcacagtgttaggagttggggtacacacctgccatgttggtggaaatcctgaagggagtgggccacacaccctggaagaaggggctttcctgaggaaggacagcctgactatgcaggggtcattccacattaccagagcttgttccagagaggcagtgggaggctccacaggcaggcttggagggtgcttggccctaatactaaatgttggacttcatggcattaacgaaggggaatcactggagccttttagtatgaagctaatctttttgtccatcacaggcaacttcttgcctacactcttttacaatatggcatttatgacatagccaagagcgaagacacgttgaacactgacttaatgctttgagtaggtggagagttgaatgactcaaggctacttctctagagattaatttgaagctagaaagtaacatttatttctgttttctgtgacagcaataggcttcagcttgtaatcgtcatctgcaagtaggtacttgacacctcccctaagtgacctggagagtgacagatacagtaatgggcacaatccttggttttttgttttgttttgtttttgagacagagtctcactctgtcatccaggctggagtgcagtggtacgatctcactcaccagggatttggccaccacgcctggccgaatccctggttttaagcaaaattttaatatggagtttatggttgttggtataatgaaatgcggcaccatagcagttgatttttgtctttcagaaccacactggctttttgtattatttcaaatttgatagatgcccaatgtatgtaacaaaaattttccctcacgtgtatttctttctttatttatttgtatgttttgagatggggtctcactctgtcgcccaggctgaagtgcagtggtgctatctcggctcactgcaacctccacctcccaggcccaagccatcctctcacctcagtactgggtagctaggattacaggccccgccaccaggcctgcgtaatttttttgttttttgggaggccaaggcaggaggataatttgagctcaggagtttgagaccaggctgtaaccccaggcaggagtacagtggtgcagtcatagctcactgcacccttgacctcctgggctcaagccatcttcccacttcagcctccaagtagctgggactacaggtgtgtgccactatgcctggcttattttttgtagagatggggtttggccatgttggccagcctggtgtcaaactcctaagctcaagggatccacctgcctcagcctcccaaagtgctgtgctgggattacaggcgtgagccaccacacccagcccaagtatatttatcgagtgctgtatgtcatgatagtgggtggtttgggggaataccaacataaataagtgggaggtttctatcctagaggagtttattgtgctctgttctctctggattgttcacaaaccagaatgccgatcaaagactttgctagggttgtgggtgggcgacttgctcaggagatccctggcacccaaatgagtgcccagaaatcactctgaatggtcaaaagtaaggcagggcagggcggtagagcacagggtgtcgaattaatttcatgtgggggctgaaatcccaggtctgtcccttcctaactgtgggctgctgctggcaaggtgctggccttgctagcctcagagtcctcatgtttaaacctcagcagtttgttgtgagtgttctaggttacagtggattccaaactagccacaagtgaagcacatggctaaatggtagtcattggtattgttatcaaaagcaagttgcttagctgggtgaagtggctcatgcctataatcccagcactttgggagcctgagacaggtggattgcttgaagccaggagttcaaggccagcctgggcaataaagtgagaacctgcctctatagacaaaaaaaaaaaaaaaaaaaaagaataaataaaaacaaataaaaattactcagagtgcagtgatgtaatcctatagtctcaactactcaggagactgaggcaggaggattgcttgagcccaggagattgaggctgcagtgagcaatgattacaccaccacactccatcctgggtgacagagcgacagcctgtctgtaaaataataataacaataataaaaagaaagttgcttaggatggctactataaaaaatgagaaatcatgatgaaatcatgtcatgttaaaaaagaacacaacaacaaaaatcagaaaataataagtggtgccaaggatgtggagaaattggaatcctgtgctttgttggtgggagtgtaaaatgctacagctatgatggaaaatcatatggtagttcctcaaaaaattagacatagaattgccatatgatgcagcaatgctgcttctgggtatataccccaaataactgaatgtggggtctcagagatgtttgtacacttgtgttcatagtagcattattcacaatagccaagaattagaagtaactcatgttcatcaatggatgaaataaaatgtggtttatatgtacattggaattttttttttttttttttgaaacagggttttactctgtcacccgggctagagtgtggtggcaccattacagctcactatagacttgacttcctgggctcaggtgatcctcccacctcagcctcttgagtagctgagactacaggtgcatgccaccatgcctggctagttttttgtattttttgtagagataaggttttgccatgttgtccaggctaatcttgaactcctgggctcaagcaatctacctgctgtggcctcccaaagtgctgggattgcaggcatgaaccaccgtgcccagccatacaatggaatgttattcagcctttaaaaaaaggaaatgctggctgggtgcggtggctcatgcctgtaatcccagcactttgggaggccaaggtgggcggatcacctgaggtcggcagtttgacaccagcctgaccaacatggagaaaccccatctctactaaaaatacaaaattagtcgaacatggtggtgcatgcctgtaatcctggctacttgggaggctgaggcagaagaatcacttgaacccgggaggcagaggttgcagtgagtcgagatcccgcgactgcactccagccagggcaacaagagcgaaactccggctcaaaaaaaaaaaaaaggaaatgctgacacatgatacaacaaggacaaaacttgaggacatcatgctaagtgaaataagccagacacaaaaagacaaatactgtatgagtccactaatgtgaggttcctcaaatagtcaaattcatagagacagaaaatagaatggtgtcttccaggggcttgatgggggagggaatgggaagttactgcttaatgggtacagagtttcagttttgcaagatgaaaagagttctggagatggatggtgtgatggttatacaagaatatgaatgtacttaatgccactgagttatatacttaaaatagttacgatacaagttttatattgtgtttattttaccacaactttaaagaatgaaaaaaaagttgcttgatgagcagatacgtgtacaaatagacagaggtgtccttgaggatatttcattaagtttgataaattgcccttcttctggctgggtatttacctaccaagcagacgggtgttcacttttttggcagagagaggacaggatctttactcttcgtcatttaatacatggccacgtggattgctggctgacagtatattgaaatggctgtgatgtgggagagggaatgataatggagaaatttacaaaggcagagattgtggattacaaagtaaggagaaacttctaaccatcaaagctgcctgcatgggtcctggagaagggtccttctccatcattaaatgtttgtcagcaaaggctaagagattcttacaagaccttttagaaaaggttgcattaaggccagggcgcagtggcgcacacctgtaatcccagcattttagaaggccgaggcagatggatcacgaggtcaggagttcaagaccagcctggtcaacaaagtgaaaccccatctcttctaaaaatccaaaaatagccaggtgtggtggcacacacctgtagtcccagctacttgggaggctgaggcaggagaatcacttgaacctaggaggtggagtttgcattgagctgagaccacgccgttggactcctgcctgggcgacagagcaagactccatctcaaaaaaataaatacataaaaaagttgcattagatggctgtaaaaggtgcttcctgatttgatgatacagttatattaatatttctagccatgcactcattaactccaaattacataataagaaagtatctttcttttttttgaggcagggtcttgctctgtcacccaagatggagtgcagtgataccatcatagttcattgcagccttgaactcctgggctcaaatgatcctcccatctcgagatcccaaagtcctgggattacgagcatgagccattgtgccttgccaaagaaagaatatttctgacacagttctttctaacaggattcgagggaattttttaaaaagttttcccaatgcaggagtgtgtgtgtatgtgtgtgtatgtgtgtttaaaatttaagtataacacttacatagaaaagtgcagaaaacagaagaatctagctgaatgcaaagccttgtgtaaccacccccatgatcaaaaagcagaatgatgttgaccctcccccaagcagtactcccctgaaaggcatctgccattctacttctagtttttgtttagtttccagtgtaggcttctaaacaataaagtgtagggaattgaaaagcagtacaaagccatttggtttggcaaataaacagattttcaagctgtgggtttggctaccaccggcatctctctgtgtgtggaatttacttgcaattcaactggagagcaagacctcgtcctgttttaccctggcgattcagttgctaaaattctcacacatgagtttgatctgagccttatttaaatacctttttattcatccattaattagtaaaattagctggcataagctatatatagctggtttttctgcacagccaagtcaatttataaatgcaaatatgtgggtgtgataagggtggtttccactgacccacatgtaatcaaacatcctgttatatgacacagtgccagtctgtgcataggcatttgaaagtactaactgggtttgtgaattcagtgatgctgttcttcaataaaataaagactcatttttctgatgttaaggaacacagcacctttgttactgactgttatttcaacttctgtttcatgtagttttgatatttatttttgttgggggtgacagagagaggcataattgacctgtggcatttgttaatccatgaagtcatgcttcacttatgcatcattcagaaaacacttcttggatactcactactcatgaatatgcatgcatatgacttgcagtcaaagccatgagttctcaatagcaaaactgttccagatatactcagagagttaaaatgtttaaaaaacttttttttaaagaaaattttccttttatttttgttgttttgttttgtttttttttagaagcaagatctcactatgttgcccaggctagagtgcactggccattcacaggcacgattatcactcacacactatggtcctgagatcctgggctgaagtgatcctcctgcctcagcttctcgagtagctgggactagaggcatgtgccactgcacctggcttagagtataaatttttgtgtcacacaagatatgaagaacatgcacaggcactggacccatctgtgggttcatctttctgtgggacccactaagggacccatctttctgtgaaaaagtcacaagtgaagtcctggccatgcaaggaataaccataccccaagagatcatgctgagcctgtagtttgcctgtctgcatcccccaacccccccagcttatttttattttattttttactttttattattttagacagggtcttgttctgttgctgaggctggagtgcagtggcatggtcatggctcctgcagcctccacctcctgggcttaagtgatcctccctcctcagcctcctgagtagctgggactagaggtgcatgccactgtgccagattaactttcttaatttttttttttttgagacagtggtcactctgtcacccaaacttaagtgcagtggctcaatcttggctcactgcagcctcaacctcctgggctccagggatcctcccaccttagcctcccaagtagctgagactacaggcatgtgccactacacctggctaattttttttttttttttgacggagtcttgttctgttgcccaggctggagttcattggcgctatcttggctcactgcaacctctgcctcgtgggttcaagctattctccttcttcagcctcctgtgtagctattattacaggcacctgccaccatacccagctaatttttttgtatttttagtagagacggggttttgccgtgttggccaggctggtctcaaactcctgatctcaggtgatccacccgcctcagcctcccaaagttctgggattacaggcgtgagccaccatgcctggcctgcctggctaatttttgtattttttgtagagatggggttttgccatgttgcccaggctggtttcaatctcctgtgctcaagtgatccatccatgtgcttcagcctcccaaagtgctgggattacaggtgtgagccacagtgccaagcctaaaattttttgtatagttggggatctcactatgttgcccaggctggtcttgaactcctggtctcaagcgatcttcccacctgcttcagcctcccaaagtgctgggattacagacgtgaaccactgcagccagccccaaaacctccagtttatttcctccagccacagttcctgatgcttggcatctctgcgttttaactgcttgtctctgttagcaactgctggatgctacagaggatttgaacaaagagtgaatcctgagaatggagggaatattggactaaggagactgaccagagcagaacagtttccaagtgaagaagtgagtcccttagttggaaataaagtaggaagagatggggaaataacttggctggattccttactaatcttggtgaataatataggtatggattagtaacactgtagtagctaatgaaaaatattccaggttgtgaactttggggtgtctgaggagcagcatgatgtcgtagtcataaactgagagtcatgaattggtttctgggctgggtgtggtggctcacacctgtagtcacagcacttggggaggccaaggcaggaggatcacttgaggccaggaattcaagaccaggctgggcatcatagtgagacctcatctctacaattttttttttaaaggaattggcttctagtcaatgctttgtcaaataccagtcttgggacattagatgaagctccttcatctaatgtttttctaatacataaaacagtaataacagatttttgtttggtatctcatccagttgttgcaaggattaaacggggtaatgtacctgggagttccttgaagagtctaattttctacccagttttggctgttgttttggattaaactgtactaccccgagccttttcttgattttggaggatccctacccactccctactcatggtacccctggcctgttctggtagattcactcatgcatcatcaccagtcctgtggggaagtggaaatttggtgtacataccaggtgcactttcattcttctcaaaatgttatgacaaatagcaaagagaacaccttttcttttatcattagctcatccttaagcatctcgttaggggtaaagcaattaaaaaaaaaaaacaagttttagctagacgtggtggcatgcccctgtcatcctagctgctctggaggctgaagtgagtgggtcccttgagtccaggagttggaggctgcagtgagctatgattatgccactgcactccagcctgggtagcagagcaagactctcatctctgaaaaaaaaagaaaagaaaaagaaacaacaacatcaaacaaagaaacaaaagcaagtttataaataaagaaacagaatagcagggacatggatgcagctggaaaccatcattctcagcaaactaacataagaacagaaaaccaaacacggcatgttcttactcataagtgggagctgaacaatgagaacacatggacacagggaggggaacatcacacaccggggcctgtcggggggtggggggcctaagggagagatggcattaggagaaatacctaatgtagatgacgggatggtgggtacagcaaaccaccatggctcatgtatacctatgtaacaaacctgcatgttcggcacatgtatcttagaaattagagtataataaaaaaattttaaaaaaaagaaacatagaataaaaaccatacctaatttagtaagagaggcattccccccaagctcctcacgtttatttatttatttatttagagacagagcctcgctctgttaaccaggttggagtgcagtggcgtgatctcggctccccgcaacctctgccttccgggttcaagcaattctccctacctcagcctcctgagttgctgggactacaggtgcccgccatcacccccagctaatttttgtatttttagtagagacggggttttgccatgttggccaggttaatctcaaactcctgaccttaggtgatccgcctgccttggcctcccaaagtgctggaattacaggcatgagccactgcacccggcctaaacttcatttaaatgatgaggaaataactgcaatggaatgagctggttggagaacgatgttactcacccgaacgctggctttatgcagtttcaacatccacaggtatcttctgattgatcgcattacagtcttgacctaatttctcctgataaggagctgaaaatcaagcaacagtacattagaactttgattcatgtgacgcctatcatgccatataaatgaaaattcagagtttagattaagaacagtaaagctttctctgttgtaccttaaaaggtacttccctcctcctcataataataagctacatgcttctggaagttttaccaagacttgagatcaggagggagcattctgacgctgagcacacctctgactttgcacatggtggtttcgaggggttgacagcagaagatctccagagtctagtaacagttctgtcttactgttcaaatttgccttttctacctcaatttctcctccattttaacagaaaacctactactactacttcatatgtatctaaaatatttcaaaatctttagtaatgggatataagcactcttagccatcagaataacttttaaggtcaggtgcagttgctcacacctgtaatgctagcactttgggaggccgaggcaggaagatcacttgagcgcagaagtttgagaccatcctaggcaacatagtgagacctcatctctataggaaattaaaaaaattagccaagagtggtggcatgggcctgtattcccagctactcaggaggctgagttgggaggattgcttgagcctgagaggtggaggctgcagtgagtcgagatcgcgccactgtactccagcctgcgtgacagtgaggccctgtctcacaaacaacaacaacaacaacaaaaacttttaaagattagtaagcaatttttttctttggaaaaaattaaaatgaaaatagacgattttaagaaaactttttatgttttttaaatcaactttaaaattttgctatatagctctatgaattttaatacatgtgcagattcactgaattattttcataatgagaatacagaaaagttctgtgacaccctccccccaaaaaaaaactttcttgtgccacccccagcccaatgcctggcaactgctgacctgttgtctgtccccattgttttgtgttttctgtaatgtcatataaatagattcatactgtatgtgatcgttttattgtcttttataataacagctttatttttacttttaattttgttttgagacagagtctccctctgtcacccaggctggagtgcagtggcacactcttggctcactgcaacctccgccttccgtgttcaagcaatcctcccatctcagcctcccaagtagctgagaccacaggcacgtgcaaccatgcctggctaatttttgtatttttggtagagacaaagtctcaccatgttgcccaggctggtcttgaactcctggactcaagtgattcacctgccttggcctcccatagtgttgagattacaggtgtgagccacccacacccagctgaataatagttttattgagatataattcacatattgtataattcactcaaagtatacaattcagtgatttttagtatgttcacagagttgtgcaatcatcaccacaatcaattttagaacatttttattacacaaaaagaaattctgtatcctttagccctcactactctcttccccttgtcctaggcagtcactaatctatttctagctctataataaattttaggaaactggttttaatgatttcctttttttaaatagacagtttcttgctctgatgcctggagtgcagtggcacaatcacgatcactgtagcctctgatcttctgggctcacgcaatcctcctgcctcagcctcctgtgtagctgggaccacaggtgtacaccactgtgctgggctaattttttttattttttgtaaggatgaggtctccatatattgcccaaagtgttgggattacaggcatgagacactgtacccagctaagtttctttcttagttggaagagttttacaatgatgccagcacagttactacctgttttacttttgtatcaggcaataattacctttcacagaaaatatagtaagaatagcaatcctttattaaatatttgtcctctgttaggtagtcaattccttaaaaggtgtaatattgatattcttgttattgataaggaaacagatgcttggggataataaatattatgctcacttaactactaagtaaatggaacccaagtcagccggacccctaaactgatgtgtttgttttatttaactttgaaaggttattttttaaaaaatcacagttgtaatatgtggaacataatgtccttgactttagtttatcaagcagactttatacattaacataaatgtaaacgcaggaataagaccacttctgggaaatgtataataaatataatgcagagaacatttattgagtgcacacggtatgtcattcgttcttctaaacactcgtcaagattgtattcaaccaatccttataacaagtgtgtgaagttggtacagttatcatcccttttcttttcttttcttttttcttttcttttttgagatggggtcttacacagttacccaggctggagtgcaatggcacgatctcagttcactgcaacctctgcctcctgggttcaagtgattctcctgtctcagcttcccaagtagctgggattgcaggcacacgccaccatgcccagataattttttgtattttagtagagatggggtttcaccgtgttgcctaggctggtctgagctcaggcaatccacccgcctcggcctcccaaagtgctaggattacaggcatgagccaccgtgcccagccttatcatcccttttctgcagataagtaaagatgaattaccttgccaatgtcatgtcactgtacgaggtggagctgaacttgggcctaggatgtttagctcaagcttaactactgctccaggaatctaatgcgctgccactcgaacttcaggaagacaagagctcagacactgaaaaccagtcagcaaggccaaaacaagagagcccccagttctgccaacttggtgcaatttttactataaccatagctgggaaaaatgaagaagaaaaaaattcactggagttgcaatgaatatttaaacattgcgtcaagtttaaagcatgatgagtgtcaagccagttgagttttctgcattaacttcagctgacaactcagtttatatctattataaatgtcactatttgttgggggaaaaataatcttcctcttttttatttttaattttttttagggataggatttcattgtgttgcccaggctgaagtacagtgatgtgatcattgctctctgcagccttgaactccttggctcaagtggtcctcctgcctcagcttcctgagtagctgagacttcagagtcacatcaccatgcccagctaatttttttttttttttttttttggtggagataggaccttactatggtgcccaggctagtctcaaactcgtggcctcaaatggtcctccagtcttggcctcccaaagtattgggattataagtgtgagccattgtgcccagtttaattttcttcttttgccaaagcaaagctaataatttttttatagctaagatttaattatgtttggattaaaccttctcttcagtatgtatctcatacttttcttttgctaaatacttatctagcttgcatttttttccacattaaggagaatagctcttggaaatcttatattctcctaactctttatcttaaaatgctgccacaaaatcttagacattgaaaagttattaaggttctagttgagagtttactaacaacaaaaagaaggataattggcaaagaagacgtggattgagtgagccacatagcccctttcctgttctggtttcttggtggcatttgcagcagtgcctctatgatgcctgagcaaaactggtttattgggaagtgatgtaaaccatactgccagtgcttttgctcagcacttgggcacttcgtggccgtgtgtctcatatgatgttcataatgcttttttttccctctccttccccccgtaatactttatgaatagatgtttccacttctgaatagttctccgattagaatagcagttacaaaatgggtaagacttcacctcgtcctttaaaacaggaaaattgatagaattcctccacctcctttcattactgaggctgtcagatgattctttaagcaaaaccccagtgttctcttgtctgatgaagtcagtgtaagtgatggtatttttacattgactttaatatgaaaggaactgtttaattgaacggtttcatctcaaggccaggctttagactccttcttgggctcatgcatgggatccttcttttgcacacctgtggcctccctggaactacttctggtggtttccctggacttagtatcccccaaacctggcagcccagggcctagtgacaggcagaggaatgtattgctcttgctctgtggggtcaggtagggccgggggaggtcctgcatgaatattttcagtgctgattcagaaagagcattgggcatacacttcaggaaaccctacctggaagctacagcagcactgctctatcctagactgaccacttcagatatttccaacgcggagctggatgtggctaggaaccggctcccagctgaatagcttgtgctgagtcattatcaagttgcatttcctggctcaaccaaagataagcagggaagaacctaaatgaaaaatgactttcagactgtgatttgggttagtataccacctcagggcagcaatggagtcatgactgcacagacacgggaaaggatctggttgcagaaaccaagtgagtcagtgatgatgtatcatcattctaaaaaacgtacctgtactttcttttttttttgagacgagtttcactcttattgcccagactggactgcaatggtgcgatcttggcttaccacaacctctgtctcctgggttcaagcaattctcccacctcagcctcccgagtagctgggattgcaggcatgtgccaccactgcttggctaattttgtatttttagtagagacagggtttctacatgttggtcaggctggtctcgaactcccaacctcaggtgatctgcccatttttgcctcccaaagtgctgggatgataggcgtgagccattgcgcctggccgtaacagtgtactttctttctttcttttttttttttttgagatggaatttcgctctgtagcccagattggagtgcagtggcgtgaattcagctcactgcaacttccgcctcccaggttcaagcaattctcctgcctcagcctcctgagtagctggaattacaggtgcgctccacaacgcccagctaattttttttttctagaagttgaattgtacaaagtacacttatattttgacacctgatccaaaacacagtcatgtaccacattacaatgtttcaatcaatatatagcatacaaaaaaaaaacaacaacaacagtagtcctatgagataagagctgaaaattccttattacttaaatgttattttgaaagtcaacatttttcttctacatattttactcataagcatggcaaaatgttacaggtctcattgtcaccactgcaatatgcatactgtgatggaagcataacctatctcaatttagccacattaactatttttggacaccttgatcaacagtgcccattctcatctagcatgaggctttttttttttggagacggagtctctctttgttgcccaggctggagtgcagcggcgcaatctccactcactgcaacctccgcctcttgggttccagcgattctcctgcctcagcctcccgagtagctgggactacaggtgtgtgccaccacacccagctaattttgtattttttagtacagacagggtttcaccatatcggccaggctggtctcgaactcctgacttcgcgatccgcccacttcagcctcccacagtgctgggattacatgcgtgagccactgcgcccggcctacgcccagctaatttttatatatttggtagagacgggatttcaccatgttggccaggctggtctcgaactcctcacctcaagtgattcgcccacctcagcctcccaaagtgctgggattacaggcgtgagccaccgtgctgggccttgtactttcttgaatgggaagttgtcttcatggtgagcagctcttctttgaggtgtttatttgaagtattcaaaagaacagagagattccagtagggaacaatgaaaatattaaggcttctatatcatgccctgtgagggaaagtagacaaagatgaaataaacttcaacaagagactaaaaaactacttgagtgtttttgattaccaacttttcatgagctgaatagtttgaaaatttgctgcttttctaagttttccctttaagatcagggataaatcatttcctggaaggatatttttcactgtaagctctttctgtttctatgttgataatctaatctgaataattaagttttattgagaccttccttttgaaagtaacttgttacctatgtatgattaacctggctattattctaaatgtagaatttaaagtgttttatccatggtagctcacacctgtaatcccagcactatgggaggccaaggtaggaggattacttgagcccaggagtttgacaccagcctgggcaacatagagagaccctatctttacagaaaataaaaagaaattagtcaggcatggtggcatggccctgtagtcccagctagctacttgggaggctgagatgggaggatccgcttgagcctcggaggttgcagctgcactgggctgtgattgtgccattacaacagagtaagacagagtctcaaaaaaaaagtgttttatcatttatgtagagcttggagtttcaaacataaagtagaattactttatcacttgtaaaaaatgtgttctctgaaagttgataaacaatgaggtagaatgactcctgaaattaaaaaaaataatagcaggactttaatagataaatctgaaataagtacgatgaacaattttttaaataaaatataccctgaagctaatactttgtaaataccaacattttctttatggctatagtgtaaccaaattcaggagtaagtaactcaattatttggctgtcgggttgatggaatgaaaataaatttcttagaatatgatatgaaatatgatatgaaattcaactttactaaactttactgaacaccagcaaatgtatttacaatcctgggttctatttgtcaatcacagaccacccttttttctgagcattttttctgttctgagttcacatatggggttaggttggcagtggataaattccagtccccaccctttaatagggcatggaattatgatgccacacaaaataatttctgtatgtgttaccctgcagatcatgcacctataaaagataaagaaatggccaggtgcggtggctcatgcctgtaatcccagctactcgggaggctgaggcaggagaattgcttgagcccgggaggtggagtttgcagtgagccgagattgcaccactgctctccagccttgtaacagagcgagactccatctcaaaaaagaaaaaaaagaagataaacataaaaggtttccattgctatgatttcaattctagggtggagctcagggtttggcaaggttccctacattattagactgcgcattttaccctttttcaaaagcaggtaaggttgtagtgtagagtgtggctagtgattctcaaccctggctgctcattagaatcaatggggagcatttaaacctccccatgcccaagctgttccctaaccaatgaaatgggaatggtgggggcctaagcatcagtattttttagagttccccaggtgattctgcttgtgtaccaaggatgagaatcattttactagattcagctatgtgggaatctttcggctattttagaaaacatggtgacctggctgggtgtggtggctcgtgcctgtcatcccagcactttgggaggctgaggcaggcggatcacctgaggtcaggagttcaaggccagcctggccaacatggtgaaaccacatctctactaaaaatacaaaaaattagccaggcgtggtggcaggcacctgtgattccagctactccggaggctgagcaggagaattacttcaacccgggaggtggagattgcagtgagccgatagtgccattgcactccagcctgggcaacaagagtgaaactccgtctcaaaaaaaaagaaagaaagaaagaaagaaagaaagacaaaagaaaacatggtggtcagtgaattaaggtggcccagttaatatccagtcagttcccacctgaatgtcagatgtcctggagtgctgagatgtgtccagaattgctagctacccagctagaaaagctaccgcaaggtcatctcgggaaaagggaaccacaaatgtcccagttaagaggatggatagtttcccagggttggagtcctttcttttcctagtcacccccaaacacttaagaggcctatgggatgggcaggggagcagggagagcctcactcctctcccatctgttgggagagcctcactcaccaaaacagcgttgccttgtctgtgtcatatgcatcatgtgagtgcatgaagtcccttgctccagggacttcccattaggcctggagtgtctcccatgcaaagagcccgctcctctgttcctgggacacacctctggcagtcccagaggttgcccattcatcttgacttctggaaagaagcctatagtgagaaaggagcatgtagtcagaaaccaccaagtgcagcatagttctacataactcacagcattcagtagttttgtgttgttgcttttctttctttttccatacagtagttcatctgatatgtgcagttacgcagcacctgttaagtcagagggctgggatggtgaggtcgccctgtaaactctgggcaaattactccatttctgagccatcttttgccatctgttagaatttctgatcaggatttaatcggggttggttgtgaaagagtatatgaacatgctttgataaagaagaaaataagtgggccaggcacagtggctcatgcctgtaataccagtactttgggaggctgaggtgggaggattgcttgaggccaagaattcgttttttttgttttgttttgttttgttttgttttgtttttgacagagtttcaatctgtcgcccagactggagtgaaatcacacccagcaatggcgtgatttcggttcactgcaacttccacctcctggcttcaagtgattcaccttcagcctcccaagtagctgggattacatgtgcccaccaccacgcccagctaatttttgtatttttagtagagacagagtttcaccatgttgcccaggctagtcttgaactcctcacctcaggtaatccacctgtctcagcctcccaaagtactgggattacaggcgtgagccatcacgcctggccgaggtcaagaatttgagatcagcttgggcaacgtagcaagacccagtctctaccaaaaaaaagaaaaagaaaaaaaaaagagagagagaggagagagagagagaaataaatgaaatgtatcccagttgaacaacagttgagctgaggtgtaagcctccagatgaaggaagaaggagcagccctcctgtaagctgagagccctgtccttaataaccctgtcctattgagaatgatttttcctcttcctggatcatgaatgcttgctcagtgagccattgccatcccttgcaaaacagactgaccaaatgctggcaaggatcagggagacgagtataaacaggtatagccacttgcaggaaaccctttggtcatttcttagaaaatctacatacatctacctcatgaccaaggaattccacttctagatattaatccaagagaaagaaaaacataggtccacaaaaagacatgtccagttctatatatggcagctttattcataatattatgcaaccctggaaatatctcagatgttcattatcagaagagtggttcaaaacattttgatatattcataaaatggggtattactcaaccaaaaaaatgagacactgatatattcaacactgattgaatctcaaaaacttttttttcacctataacgtattctatgataaacattattttcaataaaataagtcaaacagataagaatatgcacttcatttctgtgaagttcaggaacagggtcatgagaggggatgccttagaaaggagcaccatgggcctgtgaggtgtcaaggaagctctgtgtctggttttggaaggtggttacgtgggcacatacatctaccagaactgatgtcagcacagttaggatctttacctttcattgtaggtgctttttttttggtggaaaatcaaacttagttgggcatagtggctcacgcctgtaatcccaggactttgagagacccacgtggaaggattgcttgagcccaggagttcaagaccagcctaggcaacatagggagaccctgtttctacaaaaataaaaaaattaacaggacgtggtggtgcacgcctgtggtcccagctactagggaggctgaggtgggaggattgcttgggcctgggaggtcgaggctgcagtgagctgtaatagggccactgcactccagcctgggtgacagagtgagaccctgtttcacataaataagtaagtagtttaaataaataaataaatacaaatttttaaaaatgtatatctaaataagagacagggcttaattactattgcaaacattttattaccttagcagattgtaagggttgaaaccaaaacttcaagttttacttgtttagaaactccaacagttctaatgaataaagaggattataaaatcctgggaaggattagcatatgctgcttgaggtcacactgctcgttagccataccatggatgatttgcaggcaacccgttttttcctcctaagcttgaaagctaaaaatagaattaaaggtgataagggcatcaattcccagacagctaagctgtttaaaccatttatttatttatttatttatttatttatttatttatttgagacagagtctcactgtgtcacccaggctggagtgcagtggtgcaatctcgactcactgcaacctctgcctcccaggttcgagtgattctcctgctgtggcctcccaagtagctgggattacaggcaccccccaccgcgacctgctaatttttgtatttttcgtagagacagggtttcaccatgttgaccaggctggtctcgaactcctaatctcaggtgatccgcccacctcagcctcccaaagtgttgggattccaggcctgagccaccgtgccaaggctgtttaaaccttttataattgcacattcctttttagatataattttctttcttttttacttatacaatattaagaggtgcaagtgcagttttgttacacggatatattgcagagtggtgaagtctgggcttttagtgtaaccatcatctgagtagcacacattgtacccactaagtaatttctctctcacccctttcccatcctcttaccctccaaagtctccattgcctgtcattccacattctgtgtccatgtgtgcagattatttagctcccacttataagtgagaacatgcagtatttgactttataaattgttttacttaagataatggcctcctcttccatctatgttgctgcaaaatacataattttattcttttttatggctgcaaaatacataattttattcttttttgtggctgaatggtattccattgtgtatgtatatatatatatatatatatacacacacacacacacacacacacacacacacacacacacaccccacattttctttacttttatttcttcatttatttttatttcaaacactagtgtcaagggctttcagtagatcatggcgaatttgcttctctgctaagtaggaaaccctgacccagaagcaggtgggtctaggacccagaatccaggttccccatgaatgtgtgccacgtgatgggccagggtgcgactgcatttccagctgcaccctgtttcccaggaggagggcctctctgcactggaccccagtcctggcattggggagagtagtcctctagtggggacagtggggaccagccatccagggccaacaaggcccatggaggctctgtggcgctgccataggttccacctgagtgggattctgacttggacatgttcagtcataatcccacagatggcagattcgccccattggctcctcagcacattttctttatctagtcatccgctgatggacatttaggttggttgcatatctttgctattctgaatagtgctccaataaacatacaagcacttgttctttttaatgtaatgatatcttttcttttgagtagatacccagcagtgagattgctgcatcaatggtagttccagttttcattatttgagaaatctccatactgttttccacagtagttgtactaatttgtattcccaccaatagtgtataagcattgccttttgtctgcaacctcaccaatatctattgacttcttgtttttccacttttgaataatagccattctgagtggtgtaagatgaagtctcattgtggttttaatttgcatttttctgatgattggtgttaatgattagtgatgttgaggatttttttcatatgcttgctggctatttgtatgtattttttttgaaaaatatgtattcatgttctttgcccactttttaatggggttgtttgtgtgtgtgtgtgtgtgtctttttttttttttttttgagttgtttgagtttcttgtaaattctgcatattagtcctctgtcgaaggcatagtttgcatatactttctcccattctgcaggttgtcggttcattcctgttgagtatttcttttgctgtgcaaagctttttagtttaagtaagtctcatttgtctacttttgtttttgttgcctgtgcttttgaggtcttagtcatgaattctttgcctagaccaatgtccagaagtgttttccctagattttcttctagtatttttatgctttcatgtcatacatttaagtctttaattcatcttgagttgatttttgtatatggtaagagatatggagtccagtttcattcttccgcatatggcaaccagtttttgtagcaccatttattgaaaagggtatccttttcccagtgtatgtttttgttgactttgtcaaagatcagttggccgtagatttatagctttattcctgggttctctattctgtcccattgatctgtgtatctatttttatgccagtaccatgctgttttggtgactatatccttgcagaataatttgaagtcaagtaatatgatgcctctagctttgctccttctggacaagattgctttggtatttgtgctctcttttggttccatatgaattttggggttgttagacataatttctaagatatattcaggtttcacttttgttctttaattttatgtattttcttcccaataaggctataagcttaagtcaaaaattgttttgcttatagctgaagagtccctgctttcagcctgccttgtgattttcatcttgttgcagttgaattaggtttgtggcacctctgctttttgtagttttcgtatcaacaccttggtttttggctttttactaattttgtttttttttttttttgagacagagtctcgctctgacgcccaggctggagtgcagtggtgcagtcttggctcactgcaacctccgcttcccgggttcaagcgattctcctgcctcagcctaccaggtagctgggcctacaggcgcccacctccatgtccggctaatttatatatatatacatacatatatatatatatatacatacacgtatatatacgtatatatatacacatacatatatatacgtgtatatatatgtacatatatatacacgtatatatatatatatacacacacacatatatatatacacgtgtatatatatatacatatacatatatatatacgtgtgtgtgtgtatatatatatatatatatatatatatattttttttttttttttagtagagacagggtttcaccatgctggtcaggctgctcttgaactcctggcctcaagtgatctgcccaccttgacctcccaaagtgttgggattacgggcgtgagccaccgcacccaaccggttttttactaaattttaaaaattacaaggttaaaatacaatgaaatactcaaggaattgcgtgaaccatctcttttgtacagactgagatgactctcctggtgaccctgaactcgtaggggcagcaggtggaaatgtacattcactacttggtggaaagaagtctgaattggggaagtatttatacatatgtgaaattccattgtactagggtgtcctgtattttatctggtaaccctgggggcagtcctatgagctgcggggcacctgccctggagactgaggcagggagtcaaagcgacatgagattggggataggttttgcatgtccgtggaaagggcttgctgatgaatttgatttgaagattgagaaacagaggaatcaagggcgacttcttggttttaaacttcagcacctggtgccctttactgagatggagaagatgggaggggagtgggtttcaagtgtgttgtgatatggacaggtcttattgatggggtgtggtgggcgtccaaatggagatgtggaagtttgattctgagtgagctcaatatcgtcgtggtgtgttctaccacgtcccttctagccctttccgcgctttctcccatctagtgtttccctgctcaaatggaaggagagaggaacaacttagagcacagtgtgactggggcaagctaccttagagataatcatttaaacaccagctagactgctgcaagaaaagaaatgatggtaaaaataaatgtactccaaaggaatttgactaaagaatatttcaccgtgtaacacatttctgtgtgccccttttgcaatgtatcattaaggatgcattgctaggcataatgaaacaaaatgtttttcgtaatgaagtggttattttgcaatgaaagccagtcaaggaaagaaatcaggcttgaatactcctagtcacaacctttataaaatctaacgttatggttagactataccatgcctgcgcttaagtagtttttgaaattttaacccaaataagaaattcttggctgggcatggtggcttatgcctgtaatcccgcactttgggaggtcgaggcaagcggatcacctgaggtccaggagttcgagaccagcctggccaacgtggcgaaaccccgtagctactaaaaatacaaaaaattaactgggcatcgtggcacatgcctgtaatcccagctactcaggaggctgaggcaggagactctcttgaacctgggaggcagaggttgcagtgagccgagattatgccactgcattccagtctgggtgacagagtgagactccatctgaaaaaaaaaaacaaaacaaaacaaaacagagaagaaattccttcattataaggaaaaaagaaatgcacataagcacagttacaatattatatttcctgattaaaaatatgtattcttttaatggactacaaatattataatttttcttaaaatggcccgtgtgtaaaaagtttattcccctttactttacttttatatagtaatgaaatttcataattaaatctatattttgtattatcaatatttaaccactagaagaattgatgatgctacttattaaaaatgacaagtgatgtaatagagttagtgggatgtctgcctgttgaaaccattttactaggtaagtatttttattacaaaggggttggatataaactggcctcatatccaaaaacctttttgcaaaaatcaaaactggatatatcctgtgttcgcttccttttccctgggcccctctgttaaaatcttttagcaaaaagattttaccaaataattcacattgaaatataaatagttttaaagtttgctatgttgctttctttccaaaggtattcagattttagtaggggacaaaagtgtcccctaagtcaagtgagtataagaattacctatattgtttgctacaaatgcaaatatccacagcctccttgtaaagtctcattcaggggctgcctactgcagggcccaagaatctatatttttaacaaatactctggtcattcttgggactagcaaatctagaaaacaccaacttgaataaaacgattaaagttgtgcttgctgaatttcaactacattaaaggtaccagtgctggaggagatttttgaggggttgaggagaaataattacacataaattattttattaatgaaatgattcagcaaagtgtaaacgcccgtaatgggcttggcagtgtcctggggctgaaggtactgagtagaataggacgtgagacaagtgctctacttgaaataagcacagacgtggaagaagggatgtgtagttttgtctggggattcggcacagtttttatggaggatgtggtctgtgaaatggctgatttgaaacatgaaggaggctgcttatgggatgggttattctgggaagcaagcaagtgcgagggcaccagaaggtatgaagggccttggagtactgggctttcttatggctgcgagagaggatgagttggaatgagatgagcagcttatgaaaccaggaagacaggttattgtggaggagtgacttgctaagctctatcagatgagcaatgagcagtgaggaaacaggggagagatgaaatcatggctgcttttggaaagataagtggactagcatgcagcatggagaatggagaggtggagggttgttgttggtgtgtgtgtgtgtgtgcacgtatgacagagagagaaagaagagggaatatgaatggcatgggaaataagagaaaggcaggccaggtcagagggtttttaggatggcctgtgaggtgtaggagggtctggaggtcggccgtggagtggagaagagattgaggactcaggcactaatctaaggggaagggggacactgtattctaagggggccagtcctgctgctccctgtaagcactttatgtatttgacatgaaatatactgagatggcccccatactttagggtgcaaatgctcccctaaagtgagagtggaagaagaaaaaaggagaaggcacttatttgctcatgtgagccgtgtacagttccttcagagctcagagaggcactatgcagtgaatcaagccaggtcagctgctgggactaggggcctgggtaggtcacagccctgccggccatccacatgccttccaggaacaccccaatctctggaacctttcctgaggcctccattttcaggaattttgttaggaatccagataacagaatggccatagtggtgattatgttccttctacctccttttcatcagcctcgctcaccttacccttccagacatgagaaaacagtttcactacaatatccagtagatttacctaattggtaaaataagaaaggccaaggaagttgctcttctcttcactcccacccctcctgttcattttgtttgtaacaatagagccaagtttcaaacaaatgtagaaaaggtgagcaatgctaatgatgtgtttcagatgggattcagggacaactcaacttgaaattgtctcttagccatctgtttgtgtgcctggggtttcacctgctttgaattagggtaatttaataattgtgaattagactgggagagtacaaatggttttgttaattagattaaaacgttacattttataatacttactgtattaaccatgggctgatgacgctgcttgtaccctgtgttaaagccttatctattatctgctctttcttttgaaaatctcttttatttcagtttccatcgctgtgttgcagctgtccaacctctctggcattctagaatggatgctgcctgccttccatattccaacgcataaggttctttgcctgatgtcttgtgaacatacacaccgcaattccagataccattaagcctctgctatccaggtttatttatattaactatagtttgtttaaatatattttattaaactctttaaaaaaatacttctgtgaaaccagaaccaaacaaagaagtatttgaggtcctggatctttaaattttgtgatcttgggcctggctcatgcctgtaatcccaacactttcggaagccaaggcaggcggatcacctgaggtcaggagtttgagaccagcctggtcaacatggtgaaaccccgtctctactaaaaatacaaaaaattagctgggcatggtggcggatgcctgtaatcccagctactttggaggctgaggcaggagaatctcttgaacccaggaggcggaggttgcagtgagctgagattgtgccattgcactccagcctgggcgagaagagcaagactccgtctcaaaaaataataaaaaattaagaaaaataagtaaattctccttacatataaaacatatgaagcagtgctgccaaagagagagagagaaagagaaggaaagagagagagaagagagaaagagagcgagcgagcgagagacatcgaggataagagagaacaaagatgatgatttctgaaaaaaaggaatggatattcaataagcctgtacttactatcaccataagctctaagatatgacatgagtatgtttctattttaatacctctaaactcacaattaatggcatcttaatattttaaagggtagccattgttttaaaagcatataaaataatggtataaaaattagagctatcttaagttcagtaaatatagaactttgagtaagtcaatttgataattcccctttatggtaaattatctcatgatagtttcatgtttaactaaatcttcagaaaaaatttttattgagatgatcattggctaaaaaaaatggtggtatttgattggttttaaagagacacttattttgttttttgaggggaaagtgaatattgagaaaaaatagtgactgtgttcaatgttacgcttttaacatcagtaaactgcaactgacaaggctgtttcctattacctactgttaaatggccctgttttctaacttaaaaatggtgcttctaaggctaaaccttcaatttcttctggactttgtcaggttactttgggtgattttgaaagatttccatacataatactgctctggaagggtgcgtgcgaatatggttcacaaaagcagtgaagacatgtatctacaccgaggacagcatgtgagctacactgcaacaactgttttagatggccagcctgtgtttgacgatgatccctgagtgccagatgtgaaggaaaatataaatccctcaccatgtcctgaattccacaatgcctctccctcctcccctgggagtggagccaggctgacctctctctggctccatactggaaatgtgtgtggcaatggcagcattgccctttaccccatgcccaatactgcaatggcaccttaggctgtgtgtgtgtcagacagaaaaataaaacatcagatttttgttaattttgggtgatgagtgaggtcagggatagttattattttgagactgctatttttttttctcttttttaaaaacagatggggctgggcacaatggctcatacctgtaatcccagcactttgggaggctgagggaggtggattatttgaggccaggagttcaagaccaccctggccaacacggtgaaaccccgtctctactaaaaatacaaaaattagccaggcgccgtggtgcatgccagtaatcccagctactcaggaggctgaggcacaagaatcacctgaacccaggagacgaggctgcagtgagccaagatcacactattgcacatcagcctgggtgatagagtgagattctgtctaaaaaaaaaaaaaaagagagagagagagaaagatgggatcttgcgctgtcacccaggctggagtgcagtggtgtgattgtaggtcactgcagccttgaactcctaggctcatgtgatcgtcccgcctcagcctcccaagtagctgggactacaggcatacaccaccacacccagctaattttagttttttgtagagatagggtcttgctatgttgcccaggctggtcttgaacttttggactaaactgatcctcctgcctcagcctctcacagtgctgggattataggcatgaaccaccaaaaactgcagtttaaaagtgtttatatcctggatacactaacagcattttgtccaacttgtggagtggagggagtagggaaggggaggatagtgctaatgaactgtgacaggggctagcaagaaagaaagaaaaagagttccctaagtaagctcctactgggtgtcctccactcacatggagacagggccctgccttttaggcacttactcttccagtgtctattgcataatatgttcaggaaggatcccagattcaaagatttatagaattagagttaaaagggatagatatcttgtttgaccctgaaaaaattaaggaatatgcttgagatattcaatggcagaggctggaatagattttcccaaatctcctgatgtgaagttctgtgtttgtcaaacatgactgtgtaaaaagattaatttaaacttaatgacatgttgtattcatagaagttctttgggtttctgtggaaacctcctcttgctagcttaagcagaaatgggggatttattggaaggaagctgagatattgcaccaaactgcacaaaattgaatgaagagctgactaagcaaggctgcactgagaaggaaccagggtggtctgggctgtggtagcggcagcagcagcttgcagatctcccagcgctgatgctggctcgactcagacaggtctccactctctgctgtctgtctctggctcagacaggacactttgtgtggctgtttccttccacaaggcctcagtgggagcaagccagcctcccacaggcctctgagacagaccaccccattcctccctctcctgttaacctgcctttatttccttaattgcacttatcaccatgcagaagcctatgtgtttgttcccctgtggagatgtaaaaacactgatgcccaggcctaactcccagagactctgattgaactggtctgggctatggagccgggacatttgcatttttcttacaagctctaatgtgcagccaggattaagaatcattgccttctgcatcaacaggacaaatacaaaatgtgcagcaaaatatatgtttaagtgaatcaagaagacagatctagaaacgattgttaaggaataataatgcattttgtccatcaccacacataagtgatgttgaccagagccctcccagattgagtggtgccaggtgttcggggttgtctcggttaatccttactatggccttgcggggtagggggcagtgtcctcattgtccaaatgagtcactgaggctgagggattcaggctcagtgtatgcccacagttctttggcaaaccccaccactgggccagccaactacacggggattctgatcgggtcctgatgggtgcccatgatgggctgtgcaaaagtggtggtgagatttctccaccttcacggaggtggtacccaggggaggtggacttcagcagcgagaatgggctgggtgcagtggctcacagctgtaatcccagtgctttgggagttcgaggcaggagaattgcatgagctcagttgttcgagaccatgggagaccctgtctctacaaaaaaaaaaaaaaaaaaaaaaaagtgatagtagtcagacattcccgacaggcaggactgttgaatgttggtctgtgttaccaggagataacacattttaagcagaaataataggggagaaagaggatctcaattatttcaagaaaagcaggacttgctgggctttcagggctaattaaaggaaataggaaaagtgaacatgtgtgagaatctaaacctaacagttgtttattgaaaagaagagaaagagtggagagggaaatgaagttttgatttttgcctttttaggaaattgggatataatttagtgttcgtactttaagttagtgtagagtttgagtgagaagaatgaggaacataaatatgaatgctctgttaatatagtgcttttcatagaaataatggaatagaatacgcttcactgccgggtctggaaaccctccctctgtcagggtgatttagaaattgactgattttaccatggagggatgggatgggccacaggctggggtttgaagaaagaatctataatccttttggtcttaactattaggcaaatttagcttcctggtctcagaaagaaaaaacacacccacaaaaagaaaaacccatgcccgtgggaacaagtaacttcctcctcctggggctgcttgaaaaccctaatcttcctctcaccaggccaagtcccttcccttctcagcgggaggccagctggggcatccaaaaagccacaacgggccctggggagggagaatgcacccgtctgggtgagcagttgaacgtgcattggctgaggtgtgaggctcgggaaatggctctccaggcaaagacgctgcttggaggcaactttataattctttgtacctgggaaagtgaagggttgggcggggggagtgggggtgggagctttgtcacgtgaccccactctttgcttctttgtctgtcctccaacttaacatggcttgaggctgaaaaacagaattcctcattttttactcagtgacaaaatcagagaaaaaagtcaatgccaattgaaaaagacatctgcaaacatagaactgttttttctgccaaatatgtgagcatgggctgtaaatatagtaaaataattcagcagattaattgtgggaaggccagtgtgagttggggaagaatctgaaacctggaccactagaattccagtaaagtgaagagagggatagaattgaggtagagctgggggacttggggacgcatcagacattatctggagtgctgtgaaaattacaccgctttctttgttagcaggattcccattcataaagcctctttagcaatttttgtttaacaattttgtttgtgcagaatgtcacagcaacatttcttaagtgtgatcatgtcactataacctggctttccttgttttggaggacgggggcggataatgggaagtaacgcattgtttacttgctctgagagagcatttaacatatgctatttcatttaatcctcatggtgacccctgatggaggactgttatctacccttcacagatgaggaaaatgaagtttaatgaagtaacttgcttatgtttatatgtctgttaataaatggaagaacaaggatagacccaatttcccctcattccaaagtcctttgctgctttacttcaggaaattttttttttgagacagtatctcactctgttgcccaggctggagggcagtggcataaatcttggctcactgcaagctccgcccctcccccccttgcccttccccaccacccccccaccgggttccagcaattctcctgcctcagcctcagcgggattataggcatgtgctaccacgcctggctaatttttgtatttttagtagagacagggtttcaccatgttggctaggctggtcttgaactcctgacctcaggtgatctgcccgccttagcctcccaaagtgctgggattacaggcgtgaaccaccgcacccagccaggaagatttttaagtaaaagattttcagcccacattctttgaatgatcacagattatcagataatgggggacattttgtttgttttcatcgtctagatacgtctgaaacgaaaacaattttgggagttaacatttattaatcatctattataaaccaaatacattgtagctaataattaaaatatattctattacggaattgctgctgaccacaaactatggaataagcacgtggaatttctaagttcactttaattcaacaactggtgctttgttgctgacttggtaaccaggtggcccactgtgtatgttttattgaagcaagttgtctgcaaagaagcgggatagacagggtctgtcctcaaggggtttacagtctatcgaggagagagctatacacgtactaactgatagacacctctagagttacataacagacataaagttgtacataacagacataaagttgtactataagagatgtcctggggcttgggacgaaattccaaattgattgtggagagaagaaatctgaggggagaaggatgtgggctgctggagaccaggcaagatgggttttgagttacgtttggaagacaggtgagatttgcataaatgggtaggagtgcatgagccaagatgaaaaggcaggtgatgccaccgtgccaattaggagtctaacatttggagtaacacaggtgatggtgaggcaggttgaggccagcctgggagaggcagggaggggcaggttgaatatttcaggttttgtcctgttggcaggagtgttgatagcagtattacaaatgatggtatattagtaataataatgtttaaaatgtattgagcatttactccactggatactctttattccacagatatttacagagcatttacaagtgccgaacaatgtttcttgcactgataatacaagggtgtgcaaaactgacaggaatccctgctctcatggagcttacagtaacagaggagcgatggacagatgataaaataggtacattcttccgtgggtgctgtagggaagcataaggaaaggagtgggtggagaatgaatggataagggagatcacagtttcatttttattttttctttgggcagagtctcactctcactcagtctggagtgcagtggcataaacacagctcgctacagcctcaacctcccagacacaagcaattctctcacctcagcctcctgagtagctgggcctacaggcatgtgccaccacgcccagctaatgtgtttaaattttttatagagagggggtctcactgtgttacccagactagcctcaaactcctgggctcaagcgattctcctgcctcagcctccccaagtgctgggattataggcatgagccaccacacctggctgacatcacaattttaaagcctggttctatgtgtgccagtgtattaatttatctaatcaggtaaataataggtagaagacagtctccgaagaattataaacgtaggctgggtgtggtgactcatgcctataatcccagcactttgggaggccgaggcgggtgaattctcaagagttcaagaccagcctggccaacatggtgaaaccccatttcaactaaaaatacaaaattagccgggagtggtggcacacgcctgtaatcccagctattgggggagctgaggcaggtgaatcacttgaacctggcaggcggaggctgcagtgagctgagattgtgccactgcactccagcctgggcaaaaagagcgaaattccatcaaaaaaaaaaaagaattttgaatatgaagtaacatgaaaatagaattcataaagatgagtgtagcaaaacgggagggtgccagctgggaggcaacctcagcaacctgggatggttagacgtagcagggctgttgtagcaattaatattaggtagggtttagtagagaaaggagaccaatatagggaaaagaaatcaaaactcactatctgctccatgcctttccgagcctagaatccaagtgcaattatatcgcaaaactgacagggcttgagggagggtggacctaatgagtaaaatgtgaagcgaaagtgacaggatgactgagggtttgagcctcgggtgactggaatggtgagaaaaaacaattttcagtaaggaagatggaaattcaatagaattgtctgtcatactatttaagtaatttaaaaattttttgaaacgaattgggggtggcctctaaggtactgatcctttctgagagtcagtagtttctcctaatggcagtgcgggcaatgtgagagataaagcaggtgggtcccggtgccaggagaactgcttccccttcccagcacatctgctcagtttccgcctctctgtcaagctacacctgctctgtcctaacctgccatccactgcttcccacttccaaaaatttcttgcttacagattcccaaatatgcttgcttcacagcattctgagtgtctataattttttcaaggcaacccgacagcagaaaaaatacaggagagtttcagttagtgaatatttaggtcaaacaacttttttttttgagacagggtcttgctctgtccccacaggctggagtcagtggcacaatctcagctcactgcaacctccgcctcctgggttcaagcgattctcctgcctcggcctcttgagtagctgggattacaggcgcctgctgccatacccacctgatttttgtatttttagtagagatgaggtttcaccatgttggccaggctggtctcgaactcctgacctcaagtgatttgcctacctcggcctcccaattgttgggattagaggcgtgagccaccgcgcccggccaagatcaaacaacttaataaatgtttgttataatgacttagtgccatttgaaaaaaaaaaatacacatacattgaaagaaaaatatgtttttatattattcttaaatgaccacagttattctcaaatgggatgtgtacaccctgccgcacaacttctccaaccttagaatcatattggacacccacattctcactttctggtggtacttgttttttctttttctttcttttttttttttattatagcaaccacagaaaacccagttttacaaatatatgctgctgttgaaaggaagatagcatgatctaatgttgaaacagcactaccttgagtgagtacctctcacgatgtgtgagagatgtcattgtgtttcccttgaaaatttgaaatatcccagggcacctctgtgacttcaccatggcaccgggagggcctcaaaacacagtttgggaatcatggtacaggcctgttctataccatctgttttccttctcaattttatggcacttcttggcatcctcatttttttttttctttttttgagatggagtcttgctctatgatccaggctggagtgcaatggtgtaatcttgactcactgcaacctccatctcctgggttcaagtaattctcctgcctcagcctccctagtggctgggattacaggcgtccacccaccatgcccggcttatttttgtatttttagtagaaacggggtttcaccatgttggccaggctggtcttgaactcctgacctcacgtaatccaccccccttggcctcccaaagtgctgagattacacgcatgagccaccgcgcccagctgcatcctcatttttaagaaaataactggatccagccatgaccttccatttcctctttttcacctttaaactcctagagtgagtttacagtgactctccagttcacttctagtatcatatactgcagatatgtcacttggtaagtcactgctttggcttcaagcttagtccaaagaatggtttcccttttgtttgttttgagatggagtctctctgttgcccaggctgcagtgcggtggtgcgatcgtggctcactgcagcctccgcctcccaggttcaagcgattttcctgcctcagcctcccaagtagctgggattatagacacccaccaccacacctggctaatttttatatttttagtagagatgggatttcaccatgttggccaaactggggtgatccgcttgcttcagccttccaaagtgttgggattacaggcgtgagccaccgtgcccggcctctttttttgtttgttttgagacaggttcttactctgttgcccaggctagggtgcagtggtgcaatcaccgttcactgccccctcaaactcctgggctcaggcaatcctcccacatcagcctctggagtagctgggaccacaggcgtacaccaccatgcctggctaatttttaaattttcttttgtagagacgagtctcattatgttgcccaggctggtctcgtactcctggctcaagcagtcctcccgcctcacctctgaaagtgctgggattacaggtccgagccactgcgctccaccagaatgttttccaattctcattccaccatatttcttttgcgtttaaaatccttggctaggttcaaattattgcctggcttttgaccttcatactttaccacaagctcatgaatatgccaggccttaagggagaagggctttctatgtctttgtcttctgtgaacccatttaaactccaccacagccatgcggggatgggcgttattattacctttttcatgggtgaggaagcaggccgcccgtgacaccaaggcatcagaatggaacggaaacaccatctagaggtgctgcctgtccacagttatggccaggttcctgaggacaccctggacgctggtgactggtataaataagtgtcttgctgtgtttgatttttaatttttacaactatatttttataaaagtaaatcattatagctcattgtggacactttagcaatgaagaaaaagaaaaaccaactcaccacagaagcatacaagtgtttatgtaaaaatttttgattcagtttaatttgattttaatattgcttccaaacatttttattatgtaatcataatgtatataaaactttttatcttgttttataaaaattaaattataagcattttttatttaattacacaattattttagccatccttaagaaatctttatcactttcaaggtgattcttgcacataatttaaaaaccaaataactacaaagctttaacataaaacagcagattcctgccctaccttcctgaagcctctcccacgtagatttaccccccagatccaaccacttccttatcttcaactcagtggctctattatatccattgaatggcatcatgcagtttgtgtacctgctgcccatcctgtgtttacttaattgagttactgaatggttgattgagagcaatggttctgcaggattagtaaacgctgataaaggcctgttgactatgcatgtatagatgtgtaagttcagagctacattatcagatgtactttgccttgccattttataagcctaatttaactgtgcatttcttttatcataaatggctatgggcgtattaggagtgatgactttattattaaacattaatagatctcccagctcttatcagttattttctgaacctaaaattgaagaagtttgggaattaagccaagaagatctaatgaaattctattgtattttaaaccataattattaagacacagcaggtaacggcctgcccttgataattgtaaagactattgggtgttaagaagaagcacattatgtggatacatgcaacttcttgtagaaatattttcaggcagccctctttttaaaaatggaggatcccttttcagaaatactgattcccaagcatgtgggctggtgtctgtgctgccacaatatacttttaaaaaaattaatagactttattttttagagcagttttacatttgtctgttttttactgctccttgtggagcccggctaactcctaggcagtgcgcccagagctgcagttttagattcagataaattaggcagaaattacagataattgccatctagccatcactgacttcccaccctcaaccagcttattattaacatataattaactcctgtaatgaacatgttacattagtgtggtacatttgttatcactgataagccaatgttgatacattaattaaaatctacagttttcattaggattcactcttggtgtagtacatttcatggattttgacaagtgtataatgacatgtattcaccattacagtcatatagaatagtttcactgccttaaaaatcccccattcttcacatgtttattcctctattcccgaaacctctggcaaccactgatctttttagtgtctccatagttttaccttttccagagtgtcatacggttggaatcacacagtatgtagccttttcagattggcttctttcacttagtaatatgcatttaaggttcctctatgtcctttcatggttgatagcttatttcttttaagcactgaatagtgttctgttgtctggatataaaatggataaatattttatttatccattcacctaatgaaggtcatctcagtagcttccaagttttgtcaattaggaataaagctgctggccaggtgcggtggttcacgtctgtaatcccagcactttgggaggcagaggcaggcggatcacttgcagtcaggagttcgagaccagcctggccaacatggtgaaaccctgtctctattaaaaatacaaaaattagctgtgtgtggtggcgggtgcctgtaatgcccagctactcaggagactgaggcaggagaattttttgaacctgggaggcagaggttacagtgagccaagatcacaccactgtacccctgcctgggtgacagagcgagactctgtcccaagggggaaaaaaaaaagaaagaaagctgctataaacatctatgtgcaggtttttgtgtgtacatacgttttcaactcacttgggtaaaaatcaaggggcacagttgttgggtcatatggtaagggtattgtttagttttataagaaactgcaagactgtcttccagaatggttgggtcattttatgttccccagcaatgaattggagtatctgttgctctgcctctttgccagcatttggtgtagtcagtgttttagatttttcctgtttaataggtatatagtagtagagtatatctcattgttgcttggtttgttcgttttgtttgagacagaatctcgctctgttgcccaggctggaaagcagtggtgcaatctcagctcactgcaacctccgcctcctgagttcaagtgattctcatgcttcaccctctggagtagctgggactataggcaagcgccaccacgcccggctagtttttgtatttttagtagagatggggtttcaccatgttggccaggctggtctccaactcctgacctcaggtgatccgccgaccttggcctcccaaagtgctgggattacagtcatgagccaccacgcagggcccattgttgctttaatttgcaattcccaggtgacatatgatatggagcatcttttcatgtacttatttgccatctgtagctcttctttggtgaggtgtctattcagatctgttgcccattttaaaaatcaggttgtttgttttcttattattgattttaagagttctttgtctatttcagataccattcctttattagatatatattttgcaaagattttattttaatctgtggcttgtctttttattttcttaagaaagtgtctttcacagagcagaagttttagattttaatgaagttcaatttataattttttctttcatggatcattttttctttcatggatcattttttctttcatgatcatggatcattttgatgttgtatgtaaaatgtcatcaccaaacccaaggtcatctagcttttctcctatgttatctcctaggagttttatagttttttgtttttcctttaggtctgtgattcattttgggttgatttttgtaatagatgtaagatccgggtctagattatttatttacatacttatttatttacttacatgtggatatacagttgttccagtaccacttattgaaaaaaatatcctttcagtgttgaattgtctttgctctttttgaaagatcagttgactatatttgtgtggttctatttctgggctgtttattctattcatatgtactgagtctttttgttactttcagtgaagataaaatctatttgtagctaatcttggtttgtctttgactcttagtttcctcatgagaagcagggatccgtagaatagatccttcttactgtttcttccatctttactgcgtgagattagtgagactaagtgagactaagacttagtgagactaagaatacagtcgggatgatgcttttctcatagaaaatctctggatctgtttcaacagctaccagatctgtgtatgtgtctttgtgtctgtctgtgtgtgtacaggcatagtggcagatgtgatttctggttatgtcctttacattttataacaggatattaaacttaacattcatgaatgagtaagaaagcatattttgccccaatctgtaacagaaaatatcaataattgagttattaccagcaattaaaacatcagatttcctggcatgaagctttcataaggggatatttggcaatgtttgaagacatttttggttgtcacaactggtagctgggaggcctggagaggtgctactggcatccagtgggtagaggccaaggatgctgctaagtatcctacaatacacagaactgtcctctagaacaaataattttctggcttgaaatgtcagtagtgctgaggttgacaaaccctgttgtagagaagcagatttatttatatccatggatatgttttcctctttgccttgtcctctagatcaggcatccccaacccctgggccatggactggtactggtctgtggcctgttaggaactgggccacacagcaggaggtgaacagcagttgagcaagcattactgcctgaactctgtctcctgtcagatcagcgccatagtagattctcataggggcgtgaaccccatcgtgaactgcacatgtgagggatctaagttatgtgctccttgtgaaacagtttcatcctgaaaccaccaccccccacctgaccccgctctgtggaaaaattgccttccatgaaaccagtcacggatgctaaaaaggttggggaccactgctctagctaacctagactcctgatgatttgccatctatagctaataagcagcagaagcttatggtgtgatacaacattccacttcttttaggtgtcttgagctgagtttcacttttttgtaatttcataataatttctattatgttacatgcatttagataagctgacaactcttaaagtgggacataaatacactattatatgtatttctgaatatgggtggctggattgttgatcataaaaatctgaatctggaaacaaagttgatgtttaataactctccttggttggctggatatacataattcagactctgctttgaatgtccccttctggtcctttaaatggtctatttccctaccttacgtaagtttccatgagctcatcttgttttcatagtgttcccttttattgttaagagaaacaaaaccaaaaaaccccacttgtttcagcaatgccctgttgtcttcctctgtgtgaaattgctcaactaagagttatgcaaatggggatgcggcacgtggtggaggcttcttgcagcatgttgatgggggaccaagacctggtcttgcctcttcctcctccccctgctggcttcattccggtcataccagctcctgctgtggccatcagctcatcccaggaccttggcagggcctgtttcttttacctcacactgaagccccaaactcttaggctccagtaatcctcccagcttggcctccagtgcactgggattagagatgtgagcccccatgcatggctactctctaagttcttactcccacggacaattagagtttgaaggaccttaggccatgggttcagattatcttattttgcttcaaaattttaaaaacttttttatttttctgtcatatacatatacgtgtgtgtatatatatataagttatatatatataacttgtatatgttactttttatatataataaaatatattatatttttaaataaaatatattatattttaaaatataatatgtaactcgtacatagcacatattatatgtaatgtatcctatacataaccttatgttgtacataaatatgtatattgtttacctattgtactatatgtacatgtataacttgtctatgtattatgtattataataaaatacattgatacttgtatacataatttgtacacaatggaaaacatttttaaaattttagactaaggggaactgagcacaaaacctaagggcctcgaaactctgattttatacatatataaaattatacatatatgtatataaaatataccttttaaataaggtatatatgatgggaaaattaaaaatttgcaagggcaaaaccaaaaatagctgtagatgaacattgcggtagtttagcctatttcttttcagacttttttctattcatttgtaccttttccctcacaaaatgatatcatgctatatatactgtttttacattttttcacttaaatatattgtgaatatctttttatgtcaataaatatatatgtattaaaatttaatagtcacttagtattcttttgtgttgaagtatcatgttctagatcaattttccaaaagccagttaccagaagggcaatttgatgttttctcaaatgttacaccgtaccagaagacttgtttcttttaactacttgaatattatttttatttaaaaaactttatgcatttttaatgtgcttttgctagttcttcaaatgacatatcaacattgtttctgcaattagaaaaaataaaatttaaatttataagcctcaaaaagaaattgtaagtgaccaaatcatttccaacacatatgacatgcttaaactttagtttctgagaaggtgaaattaggatgtgttaacctggcagctgtttgcaaaaccatttgagttgaaaggatagaaccatcctgaaataaggaaaggaagtgttcctgtgcatagggataccagaaagaagcagaagacttgaatctcaaatgtaataaaagatgacattaaggttgaagaattttttaaaaattaaaattctaaaaatgtaaggagaggtaaagcaagaagtgaattaggaaactacagaaacaaccatatctcacattaaacttaagctactaattactagtgacagattaatatagttctaagaagactcaataatccttagctttctaaaaaatagaacatttgtcaaaatcttttaaaacaattatatatatattttttgtttgtttgtttttgtttttttttagatggagcctcactcttttgcccatcctggagtacagtggtgctatcttggctcacagcaacctccacctctcaagttcaagcaattctcctgcctcagctcctgagtagctgggatcacaagcatgcaccaccacgcctggctaatttttgtatttttagtagagacagggtttcgccatgttggccaggctggtctcgaactcctaacctcaggtgatcctcctgcccgggcctcccaaagtgctgggattacaggcatgagccaccacaccaggcctaaaacaattatatttgataagaattattatactcgcatttatataccagggaatactacacagccataaaaaatgaaatcatgtcctgggcagcaacatggatgcagctggaagccattatcctaagtgaattaatgcaggaacagaaaaccaaattgcaggctctcacttatgaatgggagctaggcattgaatacatatggatgtaaagataggagcaatagacacgggagactactaaagtgggggagggagaaggggagacattcaccaaaaaactatttggtactatgctcactacctggatggtgggatcatctgtaccccaaacctcagcatcttgcaacatacccatgtaacaaacctgcacatgtattcctgaacctaaaataaaagttgaaattatttttaaaaaagaattactatactcttaagctatgaaagcaccacaactaataccaactgttataaacttaagctgttaaaactatcccatctaatatgacattacgtaaatctgaaataattaaaagataccaattttggtgaactgatcatcttgtaagttgaaaaccctcacagaactggctttggtgatgtgaattttgagagctgatctgcatttatttaaccagtgacctataatttgacaaacaagcctatttctatatggtattccaaacagtcccacaataagtattctcttgtatagaactttgtgtagcccccagttattttcttataagtaatttattccaagaagtggtcatgttgggttaagaagtgtgtacattctaacggagtttaatatgtactgtcaagttaaagattgtatcacttatcctctcatgccaagcccagtgatttcattttatggtgaggcaattacagtccagagaaaagagtggttttgtcgataattacaggactgtcaaggctggactccacagacaggcttcctgagttcaacactgtctcattatcctctttgcactcccttccaggcagagccacatttccctttcagtttctctgttctagatgccaatcttccatatacctctttaattgtcttgcaattcttttctggaaacattctagtaaatgcagtgattaaaactgtgcccagtgctgctgccccttcacattgtggataactagatgaccctgggtctacctacggctgtgcttatgtcttgtggcaaataataaagaaggagctttggccaggcgcagtggctcacacctgtaatcccagcactttgggaggccaaggcgggcggatcacaaggtcaggagttcgagaccagcctggccaatatggtgaaaccccatctttactaaaagtacaaaaattagccaggcatggtggcgagcgcctgtagtcccagctactcaggaggctgaggcaggagaatcgcttgaacccaggaggcagaggttgcagtgagccgagattgtgccattgcactccagcctgggcgacagagcgagatccgtctcaaaaaaaaagaaggagcttcaaatcaggtaaacacagcaaacagaagataaaaagaagttggcaaacagcttaagtttgccaacagggtttgaatcttttcaaatgtagtctgtcttccatcattactgtttcttcttcttacccgctactcctttgcaatcttgtgtttaggtaggtacagggttgctgctgtgctgtttggtagaaagaagccataggttctctccatattctgtgtatgccgttcaccggcccgctaagatttgactgggcactgctgattcgagggatgttaaatggacacccaccgtgcaagtgcatgcaactgggaaacttgtggatctcctggaaaccttgacaggcagaatgaggggagccctgggacagcatctggctgttttgtcttgacacccctttcctcagtgctcaaccctgcatgagacatgaagagaagagaagagccaactccttattcagacccagagacatccctcctgtgttgaggggggtgcaccctgtaactagctagctagtcttaaacccacttcccacctcacccccctttcccaattgaccctcaatagtcaaagtgaatggaggctggcaggcaccttggacacaggttctatcccagtctttactctttccaacactccttcagacacctctttctcacttctcctaaatcatatcctcctcccttctagggggagcctgatggctcaccttagtcacagacaggagctgacacctaaccatcgaagcagctctgtggtggaggtgatgcccacaccatggacggaagcagctccacgggccatggtcatagcctagaggtgacgcccacaccatggaggcagctctgtgatctgagggattcccggcaccgaaacagcattgccttaattgcccccaaacactgttcctattacacatgacatttaaaccttagggagttacattcataatgttaggttgcctaaagaaaaaaaacaaaaacaaaagcaaactgaaaaagccttaagtagggccttatgttgcaggctggtcagatagagaaagccgtgctatgcagcttggccagcccgggttaccagctcaccaactgtgcccaccctggctgctgggagattttattgaggaaaaatattggagaatgtttgaaaataatgaccatggtatgtaaggcaaaaaatcttagttgtttaaataaagacggtctggctaggtccttttcagttctctctcttttaaaagtgatttaggtgctgggtgcagtggctcacgcctgtaatcccagcactttgggaggccgaggcgggtgtatcacctgagatcaggagttggagaccagcctggccaacatggtgaaaccctgtctgtactaaaaatacaaaaattagccatgcttggtggcggacgcctgtagtccccactacttgctactcaggaggctgaggcaggagaatcgcttgaacccaggaggcagaggttgcagtgagccgagatcgcaccactgcactccagcctgggcaacagagggagactccatccaaaaaaaaaaaaaaaaaaacaggaatttgggaaaattgatgcaagactgaactgcttgagttgggaattaatggagttggtggtggagcttagtgctagtgccctcaccaagtctctccagcactgttgaggctgccaaccaggctattgtgtccccatgtcactttgataagcagtttggagaaagcattcaactcttctgaagactttgtttctctaatctgagtctcctttccgaaagtaaagtaagaaggacaattaaagggtatctaaaggtttctgtgttggtgggcaaagtaaatctcttgagttatagaactgatactggaatgcaagtgtgtagggaacatacttttagggacgaattcctataaatgatgcttgaaccagtcttggacctaatttgaaactcaagatcacttttgtttcagatagacaccacccacctctatttccccaggcttcctttctcttcctcatgtctttctaagctctctaattcagaaaactcatggatctggagcttcctccacagaaaggcagcaagaccttgcatcagtaaagaagtgcagcttttaggctgggcgtggtggctcattcctataatcccagcactttgggaggctcacgtgggaggatcacctgaggtcaggagttcgagaccagcctggccaatatggtgaaaccctgtctctactaaaaacacaaaagttagccaggtgtggtggtgggcacctgtaatcccagctacctgggaggctgaggcagaagaattgcttgggcccgggaggcagagtttgcagtgagcagagatcgcgccattgcactccagcctgggtgacagagtgagactccatctcaaaaaacaaacaaacaaaaaagaagtgcagcttttagatagaaggaatagattctaggttctacagcactgtagggtgactataattaaagacaatgtattgtatattccaaatagccggaagagcaaattttgaatgttcccaacacaaagaaataatacattaaaaataataaaagcaacaaaaaaagaaaaagtacagctttgaagccagaccaagttccggttgtacctgagacctttgattacctagcacaggttcatctctgggttttactttcctcatacacaaagtaccagggacaaagtaggcacatacgtgtttatcccttttctaccccccacgtcttttgtctctgaccctcatagacatttatagctactctgtttgctttaggtgggtgaccagttgatattgcaaagtcaggcaatagacccagcagttgacttcagcaatccaactccatagtccttacttcagaatatgttgtgaattgtatagtgtcttctttaggaatttcaatacaaaatttctatacaggatcttttacctcacaagtggactttagaacctaaccaacaaggtggtggatgtcctcttagatttttttcctgtggacattaaatatatatacatatatatggattgtgtacatatattaggttggtgcaaaagtaattggcaaaaaccgcaattacttttgcaacagcctaatttaaatatgtatatataattttttcaatcagcaattcttgattgtttgattaagaatgtccaaatatacaaatctctctttttaacccactcataatgtgtcactttgttctaacttaaagaactaacccctaatgaggacatctagattgtctctactataagtcatgctagcgggaacatccttatgcccctgtgcagtgtatttaaagaacaaatttcaagaagtggaattccaatgcaagattgcatctttgttgaacagctggataatggtaaggcattgctagattttatgaaaccaaaaccctactgcctctggtaagagtgagttttgttttgttttgttttgtttttttgatggagtcttgctctgtcacccaggctggagtgcagtggcacaacaatcttggcttactgcaacctctgcctcccaggctcaagggattctcctgcctcaggctcctgagaagctgggactacagacgggtgccaccacacccggctaatttttgtgttttttagtagagacagagtttcatcatgttggccaggccagtctcgaacccctgacctcagatgatccacccgcctcggcctcccaaagttctgggattacacttgtgagccaccacacctggccaaggtaagagtgatttttaaaaaccaaaaaattatcccagagtctgggaataaaataaaagagggattaaaatcactcttctaatattctaaggctcttgaatgaggatgagccacccctaatggatattcattccaatgaaagaaagactttatagaaagagaaatctccagcctcacattttctggatgggtcagtgggtgttgctttgtaatcaaaaggctgcctggccgtttgtgtctctttagaccatattgtaaaacttttgcaatgaacagactagagttgtatttgcatgtcaaagcctcagttactatcttgttttaaccaaattctctacgcataaaatatgtctttatttactgttcaaaaaatggttttgaaggcactgctgactacatcatccacagcacttgatataaagtgcattataagcaaacttggaattcctgttggggacacacattcccatcaggaacctggtctgcttcctctctcctgctgtgactcatgacgtccctggcccttcttgccagaaaacctagggcaaatgtgcaggtcagttacagcagacctgttccctacaatgttaccacattcgcatttttctcattgccttggctctggttttctggttttattttattaacttcattattgactcttttgtggtaaaacattttaaagctttttttctctgagaaagaggtagcctataaaaataatctctttgtttggcattgttaataaatagatgaaacatgcatttcaaaatacccattgtatggcaaagtggtaagagcccaggctgtagacttagcttatgacttagacttgagagcgcactcctgtgtgagtgagtcttagcctcacccctcccagctatgctgtgcgcgagtcttttaacctttctgagcctcagttttctcctctgtaaagtcatctggccgtatggtttcttcaaggattaaatgagatgctcaatatattataaatgtgtaatagaagaatactaaggtggaaatcattgtaaagtgtagctcatatcacttggaacatgtaaccactctcagtttttgtcaggagtatattgtattttctacatttctggtactttcatacagcataaggaattgcaagacctgttctgagtttgggttgctcatccccatgtcacatggaggacctctgttgaggtttctggtgggagagtgtctgaatgggggaccccaaacactttgtgagcagagatcagctgtgcctgagcagtgaggccatgctaattctccacgtggctttaattttttcatttacagtgcatacattcgatgttaaattatccatgacaatggtggaaagaaattaagcataaataaatggccatctatcgatcttcctgtcttggatgtcaccaccccacccacatccacctgctttttgtttccgtccttccttttcccaagagaagagagagagagagagagagagagaacgctggagcgagcagcgagggcaggggaactgcaggaacgcagtgggggggggacaggggattccctgtgccctggttgtggcacagctcagtcagggctcggtccgtgctgggagggagctggatcgagcggcccggtgcgctgtgggttggccgcacccatgcagggctcctgccccggagctcgcggcgtgcgcagggtcctcgtgctgctattaacgtatttgcccatttgtaaagcacgattttaagggatggtgagttaaacaccgctttttcggggagggtgacggggcgtgggagggatgagactggtgaaaaaagaactcccatgcttacttagagatcaactctaaacccatggccatttcagaaactttagcgtattaaaaaatgtgctgttttgaatcaaagaagtacttgcttcccctttattttgggaactgcagctcgctagtttcagaaagaggtgtggctgctctttagaggcttcatacctcaagtaatgaaatgataaacaagttgaagttcctagaccaattggaagcctgcaggaaaaaacgcaggcctggacgcgtggcagcgatgccggagagggccgagttcccagaagagctcttgaggtttcttagtacaattcctcccccacgagatattgcctagtcacaccacctctcccccttccccaaactcctgtcatctctccttcctctagacttaactctaagccctaggcaccagatttggcagtgcttcagaattacacatcacatggggagcagcatgctcccactgtgccccagaagagtttcccggacagtgtccagagaatctgttcggtgagaaccaacttctaatgaagtttgtgagattttatttttttattatttattattattatttttttgagacggagtcttgctgtcgcccaggctggagtgcagtggcgcgatctcggctcactgcaccctccccgggccgggttcaagcgattctcctgcctcagcctcccgagtagctgggactacaggcgtgtgccaccacgcccagctaatttttgtatatttagtagagatggggtttcaccatgttggccaggatggtctccatctcttgacctcgtgatccgccttccttggcttcacaaagtgctgggattacaggcctgagccaccgcgcccggctgttttgtttttaatgcatagatttgacccaatactgtaagacaagaactgtgtctgattcaaatgttcaaaatcacctttgcagtccccagagtgcgtgtgtagtgctcagccgtcctgcgttaatggaatcactggatgacagagttcatgtttagatgtgcaccgtgtgttgttctgccctggtcaggcaccagcccccttcttgccatggtggctttcctccactgtcctagcatggcttgcggagaccgtcattttgcttttacctgcgctagtactcctggtttcctgactcaagtagcttactcagtagccctactggatttgatcatctgaatgttttcataagtatcttctctcccataagtgtgtttcctcaattcatttccagtcttgatgaaagccaggccatcttcctaggcccctacctatgtttagctggagccaggttctgcagattctagctcttcatcacctgcccttgaagtctcaaggccccccaccccactccaccttgcacactgcagattggatgtgtcatttgtcttcagggtaaaaaatcaaccactcagcttcacatccagcatgtgcctccctctctggccctgactcctgaccttccctacctgctccttgactgcagtgtttagtgttgtagatagagctcattttctgaagagattaggttgatctagctctctgaaggggccatgttatcttgagctcatggtggttgcatatgaagtttcttcttcctggaatctctttgctgactttgcaaactggctgccatcccgcccatttcaactcacagagcatttcctttaggaagctttccctgaccacctccttttcctcttgcctgagttacatgtcctttcttagatcctgtgggtcctctgtcatcgagtctttacacatctttgccacaagaatacgagcagagttagagctggattttgtctgggtgatggaaaattaatgctcaataaatatttgttgagtgaatcaatggacaggcaaacctatttgggaacagtattcactttgagtttattaatctatatatgataaagaataaaagtatattttttctactcttttttattggagacattttgatggcttgaagcagttctggaatggtaaaacaatgtcattacttttatgtttcaacaggaaatatgggatgtataaaatcaaaagggaaagacagcttgagtgacgatggagtagatttgaagactcaaccagtacgtaatactgaaagaactatttatgtgagagatccaacgtccaataaacagcaaaggccagtaagtagatagtctcaggggagaattcccacagcaagatcaaagcatggctacataatttaaacaccagtctgtaatatgtgcatgcaaaaaaattccattgattacttggtcctcaaataatttttgatatgctttgtaactttatcctttgaagaatgtataaatattttagggataactaggccactcattgtgcaattaaaagggcctttggtcacattcttttgtgtgaagaaagccatctttcatattactggtgcaaagaccccactatatatatatacacacacatatatatgtgtgtgtgtatatatgtgtatatatgtatatatatgtgtatatatatatgtgtatatatatgtgtatatatatgtgtatatatatgtgtatatatatatgtgtatatatgtgtatatatatgtgtgtatatatatatatgtgtgtgtgtgtatatatatatatatacacacatacatacataggcttgtgtgactcaagatagtagtgagaggctgggcgcggtggctcacgcttgtaatcccagcactttgggaggctgaggtgggcagatcactaggtcaggagctcgagaccagcctggccaacatagtgaaaccccatctctactaaaaatacaaaaattagctgggcacagtggcgggcgcctgtaatcccagctactcaggaggctgaggcaggagaatcgcttgaacctgggaagcagaggttgcagtgagccaagattgcaccactgccctccagcctgggtgacagaacaagactctgtctcaaaaaaaaaaaaaaaaaaagatgtagtgagattagctcagtggtttagaagcaaaaggaaatgtgggatgcaagtcagaaactaaaataggtgctaatgtgtcttttgttgtatcatactttatcctgtcctgtcatttcttcaattaattcaaaatagtacagatcctgaagttgtcatctgttattttagtgaattaaaatattaaggaaaaacacctctaattctgtcccctaaccttagagaaatagctggactagaaatattttatgagtgatgtgctatttggtgtatttcggaaatacttggcaaagaaagaactaacatcacattttatggaaaggaagaacagagctttgaacaattataacctgaaatctacttcatttccgagcttatatcctttgcatatatgtattctctcactgtatacatgtataccacccatagcctgctttctatggaattctgcagcatttaagctggaaacagtttattccagattagcccaaatcccattattaagaattttcaggctgggcatggtggttcatgcctgtactttgggaggtcacaaggtcaggagtttgagaccagcctggccaacatggtgaaacctcagctctactaaaagtacaaaaattagccgggtgtggtggtgcgtgcctgtagtcccagctacttgggaggctgaggaagaagaattgcttgaacccagagggtggaggttgcagtgagccgagattgcgctactgcactccagcctgggtgacagagcgagactctgtctcaaaaaaaaaaaaaaaaaaaggcatttttatagtttctctagtctgacatgtttttaaatgctcaggtgttttagaaatatattcccattatcaaacctttctgcctgccctcccctcaatatgtccccattaccctgaaggtaggaaatatctgccatgtatcaaagtcacatgtcatcattgagacaaagaaatcaacatcggtcttcttaagaagtggagataggccaggcacggtggctcatgcctgtaatcccagcactttgggaggccgaggcaggtgcatcacctgaggtcaggagttcaagaccagcctggccaacatggtgaaaccccatctctactaaaaatacaaaaattagctgggcatggtggcacatgcctgtaatcccagctacttgggaggctgaggcaggagaattgtttgaaccaggacccgggagggagaggttgcagtgagccgagatcacgccactgcactccagcctgggttacagagcgagagtctccaaaaaaaaaggaagtggagataaagagtggatatatcatgctattaagttatcatacatgatgtttcttgataaattaacattgtaattttatatatagaaaatatatgtacttaaaatgtataggaatattaatagatttaattgtgtgattataaatataaaatttaaaaacctattacaggcagtgaaagaaacattacataagtatgtacagatatagaaccatatcatatataaatatgattaatagaaaataaaataagagaaattagagtcacaaatagttttcttatagacatcagagttctcaaaaaaagatctgatttttctcataccatatgctatagattttgtaggttttaaaacacaagttttttcgttttgcacttatttattcatttatttattttgaggtggagatttgctcttgttgcccaggctggagtgcaatggcaccatctcagctcactgcaacctcctcctcctgagttcaagcgattctcctgcctcagcctcccgagtacctgggattacaggcatgcaccaccatgcctggctaatttttgtatttttagtagagatggggttttgccatgttggccaggcttgtcttgaactccttacctcaggtgattcacccacctcggcctctcaaagtgttgggaatacaggcgtgagccaccacacccagcctgttttttgtttttaaatgatgaataaagatgtcctttattcagaaaagtcaaggagaatagtgtgcaaacccacacaccgctttttcctcttgttcaaaataaaggggattaaaaatcaagttagaaagcagaagtagtaaacacgcttgaagtctttcaattccctcctgtataccattttttgccccttctgtggtcacagatgccctccactcatgagccagttagcctggccttattccatggccataaccaacactctcagccctggccagatatgacaaaatgcacgctatggattgattaaaaggggaatttgatgagaaggtgaggtagggttgatgcaaattcaacaacattctagaaaaagccattttaaggaaaaatctagagcaatagtatatgtgtggcatacatgtgtttcggtcttataaaaagcatattaaaatgtttgtaagttaagggctttttgaaatttgaaaaatcagcttgctgcttttaaaatgatgtaattagtttctagtcttctagttatttcctctaaatcacataaaatagatcatatatccaaattatgcaaatctgaatgactaaaaaatcaacataaaacttcctgacataaacatttgaaggatagtatgcagccatgggtttttctggtactacaatgtagtaattttccctgtctcactgaaatggagattttatgggctttcatcagaaatttaaatttcagtacaaactgttttggtcccattctgtgaagccactttaatcaaagagagacagaaaagttacatgacttgtggtataggcctctgacagcatctatcttacaagaggcccagaggcctcacacagcctcatgtggcactgtgaagaaaagaatttgattttaaaggtaattgaggtggtcttctgtgccaccaaatccttcccaataactcacccccccactgaaataacaggggatgccatctgtccctgtgatggagtcagggtcagcccaagaaaacctggatgggatgggacttgctctcagcctccagggacagagccctgaccatgcaattttatacaattggggaagcctcagatgggcagtcccaggctgggacggcaactccacgaaatcaccagggtcccacctcttccgtctccatcctgctgccgctggtgtttgctttctatgtgaagactccagccttcacttgtttctagggagagagaaagaggcaagggaaaaggggagctgacagcaaagccctgcacaaccgatctgcggaccaaaactccctctgccctctgcccggggctagagagtttggaagcacactcattgagctgggcaaactgccaccccaaataatattagggctctgtcaccaaagaagaggaggagctaggatgaggtgagcacctggcacctgcccagaacctcgctcccttcctgccacccacagcaagtgataaagagccctgtcactggccaagcagggcaggatgcacctctacaggtttttccctctgtgctcctgttctttctgacttaataaatgagcccatcctaacatctgctactgttacaaaaatcatatatacaacacgaatgtgagtaagaaaagctaaacagaatttttttttctaacaaatattctctcgtaggttccagaatctcagcttttacctggacagaggtttcaaactaaaggtatgttttcatagcaacatagttaaaattttttttctttactattagagcttctataaagtgattgtcctaaatgtttttatttttttttattgtgggacatatataacataaaaatttaccctcttaactatttttaagtatacatttcagcagcattaggtacattcacattgttgtacaaccaataccgccctccatctccagaatgcatcttctcaaactccatacccattaaacaataagtccccattgcctcctcccccagccgctggcaacctccgctctttctgtctttatgaatttcactactctaggtacctcctagaagtggaatcatacagtaattgtccttttgtgtttggattatttcacttagcctgatgtcctcaaggttcatccatgctgtagaaagtgttagaatttatttccttctaatagtgaataatatttccttgtaagtatatgccctggccgggtgcagtggctcacacctgtaatcccagcactttgggaggccaagttaggtagatcacctgtggtcaggagttcgagaccagcctggtcaacatggtgaaaccccgtctctactaaaaacacaaaaaattagccaggcgtggtggtgggcgcctgtaatcccagctactggggaggctgaggcaggagaatagcttgaacccaggaggtggaggttgcagtgagccgagattgcactattgcactccagtctgggcgacaagagcgagactccgtctcaaaagagaaaaaccaaaatgctacatgatgtttatccattcctccatcaatagatgtttgcattatttccacatcttggctattttgaataatcctgctgtgaacatgggtgtataatttcttaaatatagagttgtatttatagttttagttttaagtgatttgcaagaacaaatactggacacagtgtatacagcaaggtactctctgtgggccgtgcagaccctgagcccactaggcaggaagcacatgtccttcttccagttgccccctcttagtgcttcctctcatcctttgtgccccatgaggtttgttaaaacgcttctgctgatggattcttacaggtgttctcttgtgttcatctttagatccagaggaacaaggagacattgtggtagccttgtacccctatgatggcatccacccggacgacttgtctttcaagaaaggagagaagatgaaagtcctggaggagtaagtgctctcaagcacgccacggctgctcgtttcctcaggccactgagtcctgcaggctgtccccttgtcttgcttctggtgctacagccatagcccggcccctttcttgtaatgggtatgaggcctccttgctacccacagggagtgggcagtggaaggaatagagccaaagggattttccttttaagtcggtctgtgagcacacttcagggggtttccctttgaagacagacagtggtttttctttaaaacaatttttttttttgagatgggatctctctctgtcatccaggctagaatgcagtggcatgatcatagctcactgcagccttgaactcctaggctaaagcaatcctctcacctcagcctcctgagaagctaggactacaggcatgtgccaccaggcctggctaatttttaaaatttttgtagagatgggatcttgttatgttgcccaggctggtcttgaactcctgctgtcaagcaattctcctgccttggcctcccaaagtgctgggattacaggtgtgagccaccacacccagcctggtttctttctttatccactcttgccaccttaagaaatttgggtctgtgtggcccatgcatgatacttgaaatgtcacttttcttttgttatattactcatgtttagactgggttcatgggcccagcctagcttgagttctaagggtactgagctacagcagctgtgttgggaaattctcaactcagcagctgccatgcttttgtgaggacgcctgagtgtcgtcatctcctcaaccccctcttgctgactcagacatgtggcagtgtcagaccataggcatgcaggacagtgctcagaataagaaactccagttgctttaattctagcttgcttttcttactaatcttgcattaaatgtcactgtgacctgccaaatagggtttgagggggagactcccttattaaggacaaggtgttccgtggttgagagcaatgttgcatatgggttgaacagggacttaagcctgatcctggccctgccacttgatagctgtatgaccttgacaagacccttaaactttataccttggtttctttacttataaaatgggaatgacagtacctagatcatggggttgatgtgagcatgatgcatgtgtttaaacatgacataagcaaagaggatgcagagcttagtattagttctagttgccttcatgccttacagacaaggatcctgtctgtgtgtggaatttatagaggaatgcagttaaggctcaaagggacccattccttcccccattaccagcttacctgcttgcttcttccagtgctcatccctgcctcctccctggctccatgcctgcctttctgctgaggactcgagcatggtgctgaagctcacttgcttggaattgtcttatggttttcttcttttcatagtgtccatctctatgataactagatgtttgaacaaaggagtttataatgcatgaactgtggaccagtattcccttgactctcatttctataaggatttgaaagcatttcttagctatcctggggcaagttacaaaccttttgtttctgtgagatgggagccatttgtaccaactcttctttgtgcacccctgatcgcagtgatgcgtgctttagttgtaaggctgttttcctttgcttctgtctctaaacatattttaattccatcacggagagtgaattttcccactggattctggggttccagagatgttctccacccgccttcaccatcctaaacaaacatcttgagacaattgctattgtagctgttgagtcttggatataaacacttttttccttttatttttagttgacatggaataattatatgcagtcatgggatacagagcgatattttgatacatgtatgcagtgtgtacggatcaagtcagcgtaattagcatatccatcatctggaacatttattctttctttgtgttgtgaacattcaaaaccctcactcctggcttcttttctttgtctctctctctctctttttaatagctttattgagaattcacaataccatacaatccatctacttaaagtgtacaattcagtgatttttttagtatagtcacagaattgtgcaatcatcaccacaatccattttagaacattttaaataccccaaaaggaaaccctgcaccccttagctgtcacctcaactctcccattctctgcagccctaggaaaccacgaatctactttttatctctgaagactgacctattctggatatttcacataaatggaatcatacaatatgtggtcctttttgactgccttcttttatttagcataatgttttcaaagttcatccctgttgtagcatctctcagcactccattcctttcactgctgagtaatactccactggatggatattccagattttgtccattcatcagttgataggcattttggttgtttctactttttgcttttacaaataaggatgctttgaacattcatgtacaagtttttgtgtggacattatggtttcatctttcttgggtatatgtcaaggagtatagttgctgggtcctgtggtaagtctatgttttctttatttttaattttttaattgatatgtaatatctgtacataaatacatatttatgggatatctgtgatattttgatacatgcatggagtatgtaatcttttagcttctttttgatgtgtatttctattctaggcatggagaatggtggaaagcaaagtcccttttaacaaaaaaagaaggcttcatccccagcaactatgtggccaaactcaacaccttagaaacagaagagtgagtcctcatgtgttgtcatcttggtggctttatttgccacattggatttcttgttaatattcttcacctttttcttgccgtggaacataatatgcaggaaatgttgaaatgtcttcacaggtggtttttcaaggatataaccaggaaggacgcagaaaggcagcttttggcaccaggaaatagcgctggagctttccttattagagaaagtgaaacattaaaaggtaggaaattgttcaaagcctcttttaaaacactatttaggaaattatttttagaaactattctagagctactcaaggggaaaaaagggcatatagtatgctctggtagtaaaagttttatggtttgataacaaataacaaacctcagtgattagttgtgctactaaaagtaatatagttgagtgtggtggctcacacctgtaatcctaacactttgggaggctgaggcgagaggatcacttgagtccagcagttagagaccagcctgggcaacacagcaagaccccatctctacaagaaatacaaaacttagccaggcctggcagcacatgcctatagtcccagctactctggaggctgaggtaggaagatcacctgaacccagggaagggaggctgcagtgagccgtgatcacgccactgcactctaactagcctgagtgacagagtgaggcactgtctcaaaaaaaaaagagaaaagaaaagaaaagtactgtagaaagcacacatgattgtggccagttcttaccaggctttgtttgctgagccttttgcattattatttgaataaatcctgaagttttaagacaaagaaaattaggctgggcgtggtggctcaggcctgtaatcccaatgctttgggaggccgagactgagaatcacttgaacccagcagtttgataccagcctgggcaacatagcaagagcctgtttctataagaaattaaaaaattagccagctgtggtggtgcatgatcgtagtctcagctacttgagaggttggggtagaaagatcgtttgagcccaagaggtggaggctgcagttagctatgattgtgccactctactctagcctgggtgacagagcaacaacctatttcaaaaaaaaaaaaaagaaaatcaaagtaacttaaaaaaatttaaatgtagctaaataataattttaaaaaaattatcatgaagaaagaaaatggtatgttggcaagctacacagcaaacaaaatgccagcttcatttgtcaagtagaatttttataggacttttaaaattatgcattttatacaaatttcataaatatatgtattttgcatatttgtatcacaaaatgtgtactgcagttgttgtataatgcagatcttatttgtgagatataaacatttacttacacttttccccccataggaagcttctctctgtctgtcagagactttgaccctgtgcatggtgatgttattaagcactacaaaattagaagtctggataatgggggctattacatctctccacgaatcacttttccctgtatcagcgacatgattaaacattaccaaagtaagtaaaaactgaaggttcaacaagacaagatatatttgttatgatatgtataagacgtcaaacgctatttttatattaaaactttttatgcatcgtatttctcttagatacagttgcaggtcatattctataagtggttctaaattaatctatagttaggccaggcacagtggctcacgcctgtaatcccagcactttgggaggccaaggcaggtggatcacttgaggtcaggagttcgagaccagcctggccaacctggtgataccccatctctactagaaaaaaaaaaaattagccaggcatagtggtgcgtgcctgtagtcccagctactcgggaggctgaggcaggagaatcacttgaacacaggaggcggagattgcagtgagctgagatcgcgccactgcactccagcctgggtgacagagcaagactctgtctcaaaaaacaaatactaaaataaaagcaattaattaatctacagttaaatacacaaagtaagatttgatccttgtgaataattctcccagtccttcccacctagtacatgctgtttgacattcagtgttccacaattaccaagagaaaaatatatattgtctttgcatatatttttacaatgcatctgaatatctggaataggaatgcagatttgcagatctgtgtttgtgtgtgtgtgtgtaaaagtaatgtatattcttggtaaagtcaaacggatataacactaccactgaaatatttagaagtggcaggtcaatgtccctgtctccagtgccactttgcagtcctgagaagcctgggcctgagactctgggtccctttcctgtgtaattggagtcagttgagtggttgttgccccggctcctttctatgacctgctcgaaggggatgcacattataggtttgcttgagtcccaaaacacggagagagcaacgtgcttccgattttgtagattcttgccttcctccgccctcccattcctgtgtgcatccggcacatgctgagggcttgtggtactctggctgtgttctggggcctggggtccagtggtgacatgaccgagtccccactatggtgccctgtgaagcttaatgtgggattagtaatctgaaaccacattttattaagtgtgacaatctggcagcctgtggttgtctgttggctttgttgtttttgttcatgtatgttagcagtgctgaagaatacaatcaagtatgttttaaatggtttttcttatataaatttcaggccgggcttggtggctcacacctgtaatccagcattttgggaggccgaggcgggtggatcacttgaggtcaggagtttgtgaccagcctggccaacgtagtaaaattctgtctctactaaaaaatataaaaactagctgggcatagtggtgggcacctgtaatcccagttactttggaggctgaggcagaagaatttcttgaacccaggaggcggaggttgcagtgagccaagatcgcccattgcactccagcctgggcaataggagtgaaacttcatctcaaaaaaaagaaaaacaaaaaaaacccacaaatttcaaaagtcacaattatgtcaaggatgcattttagttcacagactgcggcaggttggacactataaggctagtgttcaacttttctttatagacacaggtaaagtacaaagtattgcatttcttaaccttcatttttccctttcaaattagagcaggcagatggcttgtgcagaagattggagaaggcttgtattagtcccaagccacagaagccatgggataaagatgcctgggagatcccccgggagtccatcaagttggtgaaaaggcttggcgctgggcagtttggggaagtctggatgggtaagtgtgcggctcggggatctatgtccttctagagatggtgacaggagaagtaaaggctcaagccaatttcgatcagcttctgagccagacactaaattatgtcagaagcatcatttattttgttttcctctgtccattggggctgagaactggcctgcaaaatctatttacttcagctcttgctctttcttgcgacttagtaattctcttaatgtttgtaaggaggggagtaatgggtatttatcttgatcatctgcctatttcttcatgattccctcatcgccagattctctggatgcacggctcaagtgcaagaaatttgcttccatctctgggaaaggttatcttagggctggaacccattggcttaatagaaagcctcaatgtattacaatttgagggtcaccaagaaagtttctaaggttctcaaagtcacgtcatgaagaaatcatttcttaacattaagtattgccttctcaggctggcaagaagtgcagcaagattatagcagtggctttttccaggggattcttttcatctacctactttaaaaaaaagtttttatagtgagctgagcacagtggctcatacctgtaatcccagcactttgggaggctgaagcaggaagattgcttgatcctaggaggctgagaacagcctgagcaacatagcagaccctgtctctacaaataaagaaattagccaggtgccatggtatgtgcctgtagttccagctacttgggaggctgaggtgggaggatcacttaagccaaggaggtcgaggctgcagtgggccgagatggcactcctgcactccagcctgggtgacacagtgagaccctgcctcaaaataaataaataaataaataaataaataaataaataaaagttttcatagtgaatgtgaacttctttggtgataagagttttttagaacaaaaatgctaaagcataacattcttttaatggttctaatggaatgtgcggttatttctggaaagagtaacatgttaggtcacacacatctgactgggtcactttttctgtgtcagctttgttgagtgaaagcaaatgtgatttctaaatggaaggggcagatggcttttaaacactctccagccccggcagaacagaagctgcagccacgtggacacgtcacctctgcatccaggttttccctctacagtcttggcccctgggatcatagccttgctcactttctcctgttggcccctcttgagcagaagtgacttttaaacacggcacatactgagccagcctatcattaattaattcttactgcactgtaagtctttctgcacatatttgcagaattcaggtaaactgtaattacatgacttcacattctccgtgtggatcggcatgtgtcagaactggctggcagtgcaaatcaggtcctcagtttctgttccactcagcagattcatgggtgtgagtgctcactctgaatgttgtctcttcccatgcacactctgttgtcttcctcctcatttctctgtgtgctctttttttaattaacatgaaattcacctgacataaattaatcatttaaaaggaacaatccactggcatttagtacattcacaatattgtgtagccaccacctccatctactttcaaaatgtttttatcatcccgaaaggaaacaatgtacccaataaacaatcactcttcattcgccccaccctcagcccctggcaaccaccattctttctgtctctatgaatttaaccactctaggtacctcatataagtggaatcatttatttgcccttttgtgtctggcttatttcacctagcataatgttttcaaggttcatccatgttgtagaatgtattagaattttcttgttttatggctgagtaatattccattgcatgactataacagagtttgtttatctacttatccattggtggacctttcagttgtttttaccttttgactgttatgaataatgctgtatgaatgttcacatacaaattattatgtggacacattttcatttctcttgtgtataaacctaggagttcagttgctggggcatgtgataagcctctgttgaactttttcaagaaccacaaaactattatatgctcattaaaaaaagaatgacttggcttcttttttcctcctttgatgtttatatttatttttttccaaatctacagaatggggcaggaatagtataatgaatattgtatacccttcacatagattcaccagttgttaatattgtcctaattttcttgttcttttatatacgtacacatacatacatgttattattgccgttgaccacctgagattaagtgcagacgtgacttgctgagttttgtgaagagtgtttaagcacctaagcagtactgtgttctcagggcacctgtcaggaggcatagtattagccggtcctattcttaatgatgttctatttgattttatctacagtaatccaccatcacttttatttaaagtgatccaaaagtttaaatggatcatttaaatttagtttctccgtggcaactttttactcccttttgtagtaaataaatactctgtgggaagtttaagattatgtaaatagaactttctccaaatggtttcagcacgatctgtgaattctcttccctcttagaagccgtcacttctctataaagctccagtcctttctgtcctcctcccttgctccttgaacatgtctattccaaccccactggctcacgtcaagatccagggacttctgcgttctcttcccggcttctccgtctgttcactgagagtattggcaggaaaaccaggatcgcaatcacacttaattgtgctcttagtccatctgagtacttactgtgactttgtgtggggagaaggaggagaagacaggaggaagggagaaaagagtgtacaggctctacgggccctgctctaagtgtgtttgcattgacattctcacttactcattgctgtagcactgtgaatgagaggcattactgtgatcattcgataaacaacatcactgagaatcagataagcaacttactcaaggtcattcaaggcagtgagagagccaggctgctctggcatctgggaaccctggactcaattatttgctacactatttctaagctaatttgacttccctagcctcagtttccacatcagtgaagtggacaaactccaatcttcagttgttcaaaggaagaatgagattatgcacctgggatgtttcccagagtctgactccgtgtgccctatttttattattgtcacttttttgttttttattctagttattggaagctatattttggtgtattttccccaattttaatcataaaacagagccataaataatccaattagactttcctatggatatttgctggcaaaggaattaacgtgtctgtcatgaaaagaaatgtagagggaggttaatcaggatgtactggttcatcctaaatcagtagccctgcatataaagtcatggcttggaatcttgttctagcctctcctgttcagctgtgaagccaggataaagcatcaaattgcatgctatttgctcctgagagacaagtaaagtgaacaaagtaattcaaatccaactgcttgagtgaattatttcttagtaacactgtttttaaagatgcagttgttggcagggcacggtggctcacacctgtaatcctggcacttcgggaggccgaggcaggtagatcacttgagctcagaagttcaagactagtctggacaacatggtgaaaccctgtctctatcaaaaatacaaaaaaaaattagttgagcatggtggtgttgcacctgtgtttccatctacttaggaggttgaggtgggaggatcgcttgagcctaggaggcagaggttgcagtgagctgagattgcgccgctgtcaccaaactgggtgacagagtgagaccccatctcaaaaaataaataaataaatatgcagttgctgccagcctggatgcctggcatcaaaagtgctgctgtcagctgtggtgtcagtgcgtcctgcagggggtgcctggcgaggttgggagcaggaagtcaggagctaggcagcctggagcacacacctcagcagacctgcttacaccccctgttctgtcgtaaggtgtaagtctgcactaaaattgtacacctggagcttaagaacattggtcctttctgggattgggaaaaccgccttgcttctaattccagatacactgaatcctccaatttctcttctttcctgcacacagcttaattttagagaacttttgcttaacatatattcaggtggtgcctaggagaaacaagtttagaagagaagagaatggagtgttggaaagtatctgattgttttatacaaatttttactttttatttagactgaaacaggataaaaatcttgagaaaatacatcacttgaatagatttgctcattccgtttttaaaaattgtggttaaatacacgtgacataaaatttgtgttttagcgatgtttaggtgtacagttcagtagtgttaaatgcatctacactgttatgcaaccaatctccagactctcttttcatctgataaaactgagagactgtgtactctttaacaccaactccctgatcccctctctggcaaccaccatgctactttctgtctctatgaatttgactaccttaggtacctcaaataattagaatcatacagtatttgtctttttgtctctggcttacttcacttagcatgatgtctccaaggtttatctatgtcgtagcatgtgtcagaatttctttgctttttaaggcttaatgatattcctttatatgcatacataaccttttgtttattcatctattgatggacaattaggttgtttctaccttttggctattgtgaatttgccactgtgaacatgggtgcacagatacctctctgagaccttattttccattcctttgagtataaatccagaagtggaatggctggatcctgtaattcttctatctctaaaatttggaggaactgccgtactgttttctacttcggctgcaccattttacattcccattgaccgtgtgtaagtgttccctttctccacagcctcaccaacagttgttattttctgttttggggattttttttgttgttggctggttggcttttgtgatagttgtcattttaatagatgtgagatggtatcttactgtggttttgatttgtgttttcctaataattagtgaccaagcatcttttcatgtccttcctggtcatttctacatcttctttggagaaacgtatgttcaagtccctttctcactttttaaattgtgttctttacttgatttactaataacgttttaaatgacagaggcagtagagcctcatctaaaatggggtttaatggaacctatctcagagggattacataacaattgaaagaaattgtgcaggtaagttcaattgacagcattcaaagcactgttattaaataatatctttagtaagaaaatatgtcacattagtgcaaaggctatacagcagaggaaagaaattgcccagggtttcccactaaatagaagttgtttgtatttttgctttttaattttttttattttgagataattgtggatttacatgccattgtgagaaataatacaaaaaggataacatatgtccacgcaaaaacctgtacatgagtgttcatagtagcattatttgtaatagccaaaaagtacaaacaactgaaatgtccatcagatgatgaatgggtcaataaaatgtggtgtattcatacaatggagtatttggcaataaaaaaaaaaaatgacctggcatacttcaacatggatgccatgctgttttatggatgacttataataacactatgttaagtgaaagaaatcaggcccaaaggagcacatattatactgttccatttatatgaaatgtccagaataggcaaatctagagttagaaagtagatgactggttgcctagggctggggggcctgggagtatggtaggagtgactgctaatgagcatgggatttctttttggagtcatgacaacattctaaagctaattgtggtgatgattgtacaattctgaatatgcaaataactgatgaactatatactttaaatgggtaaatgacatggtatatgaattatatttcaataaagctggcaaatatataaaagaaatgatacagagagatcccatgtaccatttacccagtttcctccagtggtaacatcttgtaaaactatagtacaacatcactaccaggatattggcattgatcaccgttcattttttaattgtgcttttcttccagtcttatattgaatggaggaaggaaggaaaagaagggaaggggaggaaaagaaaatagaagagaaaaaaatagaaaattttgacttgggatcttttgcttgtagggactgagtttgcctgtcagtcagcgagctccttcttcactcctgaaataatttaaatatgttgaatacacatagcagaggaatattgggaatacaaccaaaagagttgtgattggtgattttatgttacaaatagactgaaggatactccctctcccaattttgagctgctagaatttagttttctcttaccctttttagtttctcaaaggataagcaggccagcttttctcattgatagaaaaaatacaattaaaattctatcactgttaacccagtaagttaatatttttgttaaacataaggaattgttcatggacaacccatttcattttatggtctgcatttttttggcttgaaatgcagtgaacaaatactaggaagtgacctgttctttgggggaaggggctgggtggggataaaagaaagaggtgtctctgcttcaagctgtttcctcttgtttgtgtgatccttgtgacatctgacttgggtgacatgcttcctctgtggattgtcctattcccagggaatcaactgggcagtgaggctaaggacgatgtttcctctgactgcttggtctatgaagagaccctgaggaaggaaggaaacttattttacattgaattttgcttgataaattctcatttgagccaactgccttgagattaatcaccaacccacttccaaaatcaactgcatgcattttttaaaaaccactctcccttttgtggtacgtgggcactttttagcaagccagtcacagccggaattagagtgctctcaaggtgccacatcagctttctttaactgtggcaaagtgtcactccacaagacgctttttactagctcaaaaagttttttttaacataatttttcatctgtattgacaacccaaatctccatgactaggttaatttgaaccttcaaactaccagagagtatcttagaaacctatgatttgatccttagcactgaataaaaatcatgcctttaacagagggatgaaaaccaccctattgtttcaatatcacagccctaagagatcatctgggagctgccgccattcttgggccatgtttgacacagctgctttatctaccactcacctcaaactccttatcagtatttaaaatatatgcagctgcaatatttcctgatgacttcccccctaaccttggaaagcgttttttttccttcgtcctttactcatacttttctatttataagtctccatgagcttcattgtttttatgatggcaaaagggaaatggttttgtttctttaacttttattgctatgtaatgtaacaagcagacagaaaatgcaaacacaaatatctaatttcacaaataattacaaagcaaaaactggtgtgtcgacctctgagaggaaacttgctagccccagaagcccccaccgtccacccatcccctcccacccacaccctacctgtcccccagagacaacagctattccgaccttcctgatggttttctgacttcttcttaattttgccacttttgtatatggggatgtatgcatccccccaaaatatagctcagttttgctgtttttgtactttgtatgaacgaattataccaaatgtgctcttttacgtcttgcctcttttactcaacgggttggtgagaggcatccatgcttttgggtgtggctacagttcattcatcttcattccatgtggtgttggtaagatacatgtggcttttgggtatggctacaattcattcatcttcattccatatggtgttggtgaaatgcatccatgcttttgggtgtggctacggttcattcatcttcatcctatgttgtgttggtgagatgcatccatgcttttgggtgtggctattgtttattcatcttcatgccatatggtgttggtgagatgcatctgtgcttttgcgtgtggctacaattcattcatcttcagtccctatgatgttggtgagatgcatccgtgcttttgggtgtgactacagttcattcatcttcatctcatgtcgtgtttgtgagatgcactcgtgcttctgggtgtggctatggttcattcgtcttcatcccatgtcgtgttggtgagatgcatctgtggctacggttcattcatcttcattccatatggtattggtgagatgcattcatgcttttgggtgtggctatggtttattcatcttcatgccatattgtgctgtgctgcatgtgttttcaagatatacgatcatttatccatttatttcaccatttactgatgaaattggagttcatgttagtccattttgctttgctaaaggaatacccgagactgggtaacttataaagaaaatgtttatttgctttacggttcttcagattttataagaagcatggcacctgtctctgcttctggtgaagcctcaggaagcttccattcaaaaaggaaggcaaaagggagtgagcatgtcacacagtgagagcaagagagtgaccagaagaggtgccatgcttttagacaaccagctctcttgtgaactaatagagcgagaactcactctttaccacggggatggccccaagccattcatgagggattcattcccatgacccaaatacctccctctagtccccacctccaacactggggatcaaatttcaacatgagatttggagaggacaaacatccaaactatatcagagtttttcccagtttgggctgctatgaacaatgcgctgcacatttttgtgcctcatttttgtgctgatgcaagcatgcatgagctctagggtgagtgggagtggatttgctggatcgtaaggtgtatgaatcttcagctcttctaagttattgccaacttattttgcaaagtgctggtcccagcttaagattctcaccagcaatatgccagtccccacgtcccctttcctgactagcagagctgtacttagagagatgtgggccccaaggcagcacaggcagtgggtggttatccggaaggaagtgtgcactcagcatccttcatggacaccttggatgttgtcacagaagctctgcaattgaatttcagtgatgctcagcaaagaacacagaatgaggcctagggcagctgctccagagtccctcccaaggggcaggtgctcatcagcacttgatattaccagactttaaaaatttttgctgagctcggcagtggtttctcatgactttatttgcatttctctggttgctaataagattgagtacttttcacgtgtttattactcatatgaatttcttcttttgaaatgcccttccaagtctttgcctatttcttctgatttttcttattgatttgtaagaattctttctatatcctggatgcaagttccttgcagttatatgtatcatatagtttatgtattttcatctattttatatcatgtattttcctgctgtgatttgctatggatatgctcatgtaacttagggttagagttagggctggggttaaggttagggtttataaacgttaaaaaatttataataaaacctttttgatttaaatgtaatattaaaaggcttttgttggtggaatgtactttacaataactcttaagatctacagaaaaggccatattgcttgtaattatgcatttagatgtcagaacaatttaatatattcataattccattattttaggtaggtggtagctttttaaaaggacctaggatggtttttttttgtcagctttatgttactatcttctccatatgttctaacacttatcttgtactgcatttttctttttcttttctttttttgttttgttttagagaagggggtctcactatattgcccaggttagtcttgaactcctgggctcaagcgatcctcctgcctctcaaagtgctgggattacaggcatgaaccaccttgtctagcctcatttttctatagagcactgcaagctcctaagtattaaccaaagtggaatacaaaataaaacattttaatagaggaatcagtcttaatgaccaaaagaaacatcattggataggttgactgctagctataaataaactttttattatttgtttgaaggcttggaaatagatgtataatacatttctttattatttaaaaaaatcattttttaaaaagtacatacttggctgggcacagtggctcatgcctacaatcccagcactttggaagaccaaggtgagcagatcagctgaggtcaggagttcaagaccagcctggccaacatggcaaaaccctgtctctcctggaaaaaagaaagagaagagaagagaaaagaaaagagtacatactcattgacaaatccaatcagaatagaaaagaacaagagaaagtagaagtcactccaaattctaccagccagggataatcactgttgttttactcagcaggcttccagtcatctttctatgctattcacatacagatactcttgcaccctaaaaaggggaccgtccactccacgtcacctttccttaggtggatagggcaggtgctatccagcttttgcgcaccaggcagcaggaactgcaggaagatttgcagtgacaccagcagctattactcccttctccccattttttttttaacatttccaagagaaagatggaagcagaagagaggacaggaaggaagagtatgattattaatatttctgctttgccaaattactgagaaaaggctttcccaagagaaagtcaggattaaagtgctcaatcccagtcccagaagggtggtgcctcgggggaactatactaaggagtcagtattgcccagagcgtgttccatgcggtgtaagaggctacttgaacaagtgttctgaggtcaagaaattgtgggaaacgctggggtgaacaaatgcaggcttttcccctgaaggcctcccagggcacctgctgcatctcctgggtgggggaggagtggagggagtggctccctgtccttttagtgggggatcctttttcactaacagtcacccaagtccagttgtctgcaaattttgggaagtgcttgtttgactctagcatattgtactttaaagttagtatatataagtaatttttataaagaacaccttttttaaagaaaatgtggtaaatagttaaagatatggtgaacaaaattaaaatcgctcgtaatcacaccattggaaataaccagcatttgatatattttggtgtcttttcttccagactgttgtttatatgtgtgtgtctgtgtatctataaaatatgtctgtattttaaaatggggattataatgtgagtgtatgcctgtgtgtgtatgtatatgtatgtaagggattatagcatatatagagttttgttttgttttttttggtcttgaataaagaacattttattattagagaaaaatattagtcctcggctgggcacagtggctcatgcttataatcccagcactttgggaggctgaggctggcggatcacttgaggttaggagtttgagactagcctggccaacatggtggaaccacgtctctactaaaaatacaaaaattagccaggtgtggtggtgggcacctgtaaacccagctactcaggaggctcaggcataagaatcgcttgaaaccaggaggtggaggttgcagtgagccaagatcgtgccactacactccagcctgggcgacagagcaagacgtagtctaaaaataaataaataaatattagccctcatggtagagtgccaataaaaacgtttttttgctactatttcatagaaaccttttgatttttgaataatttaaacattttttggtaaagaaagaaaattcctagatacttttcatctagcctcccctaattttatcactacatagtgttttaactcaggctttttctatctgtaattaaattttttgctaactctgcatctacaaagtgaagttttaatttttttttttttaattgagacggagtcgcactctgtcacccaggctggaatgcaatggtgcgatctcagctcactgcaacctccacctcctgggttcaagcaattctcctgtctcagcatcctgagtagctgggattacaggcgcctgccaccacacccagctaatttttgtatttttagtagacatggggtttcactgttttagccaggctggtttcgaactcctgacatcaggtgacccactcacctcgacctcccaaagtgctgggattataggtgtgagccacctcccccggctagattttctgttttataaagcatgcccgccttcttttttcttcctaggttactataacaacagtaccaaggtggctgtgaaaaccctgaagccaggaactatgtctgtgcaagccttcctggaagaagccaacctcatgaagaccctgcagcatgacaagctcgtgaggctctacgctgtggtcaccagggaggagcccatttacatcatcaccgagtacatggccaagggtgagttcctcccactgcccagagcttgcaagggcttcaaactcaaaaagtaaaatgtgtaagtgttcagaggtcactcaactagtttaattatcaaacagtatacccactaccgaaaaatcaggaaatatgggaagacaaagcagtttataaacctaatcaccagaagtaatccatgtcacagaattgaaatctaatcctcctgttttctctgcatctgcctgcgtgtacctattgccctgagaatagtaccccatatctagtagcccccaataaatatttatcaaatgaattactatgtatttcaaaaaggaatttttgaaatacatatgcttaaaatgtgaagagttcccagaattctaatactacagatttagtacggattgttcagtaccaaattcctctttcatttttttttttttttttttttttttggaaacagagtctcacactgttgcccgggctggagtgcagtggtgcaatctctgctcactgcaacccctgcctcccgggttcaagcgattctcctgcctcggcctccctagtagctgggactacaggcacgtgccaccatgcccagctaattttttgtatttttagtagagatggggtttcgccatgttggccaggctggtctcgaactcctgagctcaggcaatctgcctgcctcagcctctgaaagtgctaggattacaggcatgagcacccagcctctatttgttctttagcgttatctaatattcattttccttttcagcattatctaagtgttcagggtgtcacttttaaatattaatgttttttaaaacttgtggaggttaaagtcctatgtaatcatagaattgctggagaatagacttcaagcaatcaatttttcttctactgtgatcaccttcatatacaagactttgaatcaacatccttcttcctttgttcacctccagttcaggaaacatactaataaactgccaaattattttttacgaagtcctcagaagtaatgaagaaacataagcaatgatccaggattaacaatcatctcatgcacaatggagatgatagtatgatgtcatagctgaatagattcaaaagatgaatattacattttcttatttaatatctgtgagtatttcaaaatatcagtcactcagagtctttccaaacaatggcattgtttgttttaaagcaaacaaaccaattagctcttgtggcttgggttgccatatatagcccagaaaccaggctcagggccagacaccttataggagttcagtaaatattgttgaattaattaacttagagtattcctaatgataggtataaatatgagttttcctatgtaacaatgcctaatatatatatatatttatttttttgagacagagtctcactctatcacccaggctggagtgcagtggcactatcttggatcactgcaacctctgcctcccaggttccagtgattctcctgcctcagcctcccaagtagctgggattacaggtgcctgccaccatgcctggctaatttttgtattttttagtagagacagagtttcaccatgttggccaggctggtcttaaactcccgacctcaggtgatctgcctgccttggcctcccaaagtgctggaattataggtgtgagccaccaagcttggccaacaatgcctaatatttattgagcacttactatatgccagactgctcttggtgctttccatgggtgatctcacttagtcttttcagcagcctgagggctaagtactattgttctgtgtcatagatgagatagcataacgtttactgagcacttgctacctgtcaaccatcatggtatgtgctttggatgcaacctttgattccaaccccccaaaactgtaatatagcctctagtacatgcccattttacagagacctagatgaggtaaacaacttgaccaaggctacccgtaaggctggtacttaaagttctaggggaaaaacaggtcttgctttagagatgaagccataggaggttggagagtttgttcagcagcacactccttcttaggtaggtttccacttttttccaaagcacagttcactcatcaaatattctttgaggctgggcgtggtggctcacacctataatcccagcccttttggaggccaaggtgggaggattgcttgagtccaggaatttgagaccagcctgggcaacatggtgaaatcctatctctacaaaaaaaagaattagctgggtgtgatggcatgtaccctcagctacacaggaggctgaaagtgggaggattgcttgagcttgggaggctgatgctgcagtgagatgtaatcatgccactgcgctccagcctgggtgacagagtaagaccctatctcagaaaacattcattgagcacctacagtaagtgccaagttctgtgctttttgctgaatacagatgggagtgagcctggccaagtgtctgcagagggcaggccttccagtgagctcgctaaagattgggaggtggcagtgagtggatcatggtggcaagtactctgaaatgcatggttctcagacacctgtagtgagaaaagtggtatccacccacattctttctcacctggagcacatgccatgtttcacatcaggtcaaaggtaacagattagaggggactgcgtttgaccaatgccaggaaaaggctttatataaccatacagaattgcaaagccaatcattttgtggggagttcccctgtaatagtaatgatgatgtgaattttgtttggattttttcttgtgtgtttggaatgcactaacttgttctttctttctccataggcagtttgctggatttcctgaagagcgatgaaggtggcaaagtgctgcttccaaagctcattgacttttctgctcaggtaacatattcaaaaagccccgtgtgcacgtgcatttgcaaagacttccctgcgtcaaattcatgaaggagttattgttccagggagaaggaatttctgttgaatgtttcccagcagcagttatgagaaaaagaccttccacaatacaattcttggagatagtaataggacattcacatggattgtgtgtacgtgttgagttttgacctggatatcatcttctataaaccaagtcaacctctttatgttcatttcataagtcatagaaacagtgcagctgaatcaatcactttctcagcatttgggagaggcagttccatgctatgtaagcacagcagcttttaaatgatgcgtatgttttatttaagttacgaatcgaatgtatggatacttttaagtcctctgtattcttgaaaacagaggaactatgtcactttcctgctcctcttctcgctccttcttgttggatgtgccatcaggattctgtgaaatattcatttgtactatttttagtactagcctaggagttgcctgtttatttactttggaatcacatgtttcctgaagtgtatttaagagcagaagcaagttatccagaagccccacaatgtgcccaaaatatcaaggaaatgcacacttgaatgatgccagctgctggcttttactagtttcattgtgtccattagtaatgttcagcagtttgcttgcttgtttctcagtattggcaatcggtggtttcatgaagcccagtgtatgtagcaaaagagatttatagaagttctagggaagactggtccctatagtcttcctttttcactgccacttcttccctcacaccctcttttagttaggaaattgctacggccttcttgggaatacgagatccaaggaatgcatgagtacagaggtgaagcacctcacctaaggtagggctggacacaggttctgtaatagagcatcgtgggctaagctggcattcagcacctggagactggagtttgtgttctggctctgccactcgatagctataccgcttccatttcagaagccctttgcctatttgggctactttattcacctgtaaaacagaatggtaattcctgctttaaggagatgttgttgagagtcacatcagacacagatgttgttgtgtcacatgcttggcacggacacaagcacctcagagcctgctggtggaagctgggaaaacccaagggagggcaatgcccatccttccagtaaaggtgtgtgatgggtgagtcacagtgctcaggcatcctctccacctccgggacttggcaagcctaacaggttcctcatctgagttggaaattcaagtgtgccctgaaatgccaacatctaataagaaagaagcataattgctgtggtggaacagaggggcaaggaaaggacccagcagccctgcctttttagccctgtcctcaaagtctatgctggcccctgggaggctccatgggattccaaggtttccagaactatagtttgaaaaccacctctctgcagtaagaggaataggtggggttgggcacagctctagaacccgtgtagaaaacagatcaggaaatggagaaagcagaagtctgataaacttgggccatacttacacggatcaatgaggccctctactcaggtggtgatttgggtgtccccatgggtcaagagacttgaggagtgtaacaaaggtttgtcacacttgtacagggctatggaacatcgggacacatggcctggagggcctgagtggtcacagccgttccatctgctgggggtctgatctgtacccacagttctttagagtagaagttacacacattgggtatgtactgtacccggagaatgactttattttgtcacatgggtattttgtattgggttttgcatggcttatcttgtaagactttatcttgacatagtcaaagcttttaaggtccaagtcaaagcctctatgctgagtctttaatttagtgaattactaccattacctcgaaaagtaatttttctaacctcgaagagtaatttttctaacctagaaatgaatagggggagaagctactttctagaccttcatagcttacgaggaagattaccacagagcctggcattgactgtgactgttgtgctgtggattccagggggcttcagttgactctcctgtcaactgatggggctgagccccctcggtgacaggagggcctgggggcaatcaaggtcggcaccagtggtctccatccaagccagtttaccaaatccagcccgtgccaggtgaactcatgttcacaggtccagggtctctttcctagcagtggccccttggtggaacccatagttcatctggctcaagtgcatgaactgctcagtgtcactgggagagtcacgggtcagcagcagccggcaggaccctaagtatgttcattcagcacaaaattcattttccttacaactaagcactggctccatttgagttcatctttgctcaagctgcaaacctcactcagactctttcccagcccttccctcaaggtggcgctggtgagaccacctggtctccatccttaatcattatctgcttcttgtacctgtggcttttcttattataatacagataatttgagaaaggggtcttacccttggcaacaaggagtagggcctgtacgcttcagcttcagcctgaaatcccataccttccacttctagtttctgctcactgcgcctgctccctcgtccgcctgggatgccctcactgatgaccactgctacccagtgctcctcctcctccttcacacacctttctgaaatgatctgtctgtgccaagaaggccatctctgcattatcttacctttccttctctatcatgtgccactaattaaatctatcacttttccatagtgcataacatgacaatagaattattattaaagctgccccacggtgacagagatccctggggcccagatacttcgataatccaaccttttctataccttccccccactttactatttagggtggaaatttagggataaagcagaagaggaattacagaagtccatttgctgtgtcagctctaactaaacagttagtaggctgtgcgataatgatgcgacttgctgtcttccataaccgttgtcaatagcgtcagagttgggaaattgaatgttcacaaggggtggttaaattcagcagattgtcacaatgagagattggtcattgggagtagaaataacccagtttacttaatcctagccctagaagaataagggaaactgtgaggggcagagttgggacttttcccaccatctgtatctggcctcttcttcccgctccccactacccacttccccatgccctactctcccctccgcattcccctgtcacccattgagacagaaagtggctaagtgcacgtgacagcctcacagttcatgtgagagctgatttcatcacttcctgtctcagaatgagttctgaaagacttgtctgagctcaagtgtaataatccacactctccaaccatccatagcccattcaacatagatcaagaaatcctgactacagcagctttacccactgcttttctctttgtattaaattaagcaatttagtgctttttgtgctgaaataggaaaatacctctttggaaaggaagtttgatactttcagagcagagagactttgcataattcccttggcttttaggccctatgtcagagaagaaaaatgaacttggaaagaaaaggggttaaaaccagtggggatttccttcaccagaagctgagatggaatcatagacatgtcaaactgagaggaaagagcagtgaaaaatttacagttgcagtttggagagcaaataaatcatcttgtaattcagaccaagtgaatcaaagcatttattactctttggtggcggtatctctgaagtgcaaaaattactaaaaatggaacaattgtttgtgagttaaatgtcagtaaaaactgcaaaatcaagccaaacaaagtggcatgcacctattgtctcagctacttgggaggctgaaacgggaggattgcttgaggccagaagttcaggaccagcctggacaatgtggcaagaatctgtctctttaaaacaaaacaaagcaaaacaaaaaacttgcaaaatcagagttgttgtaattatcatggcaacaagtaacatttattttagcttcttctggttgatacagcacttctacctccattatctaatttgagcccaacagccttgaaagcatatattttgttgtttagtacctcttacagataacgaggtaaacttggacttggccaaggttactgagctagtatgcggaattgctgggacttgatccagggacttctgactcaagataactgattctttcctctgcagcctgctgttgtctcatggttacagttgctgttatggtcattttgcactcaaccctactgtgatatgcattttccccgttatggattttgaccatcaaaattaatgttttctttagctttttccacttcaaaagtctttattgccaagatggaggttatgctcaaggtatattttacccccagtattaaatttaaagccacattttaaggtggaaattggtaaaatgaggaaggtaggaaaactctatctaggaagttctcgacctttttgagtaggagggccttttaacagcagagctttctgagcacaccctcatggttgtagctactgagtgagaaaacagtgtatagattgggaagcccttgtaatatctcttggttgaaactcaccagtatgttggtcgtaaatcaggcttgaagggtctagagggggaagttcttgggaagtttctagaatatttgccaatatcatccaaagtgggtctcttcttctgtctctttgtctggaacgtaagagatgtgttagacgctcatattccacctcaaggctattatcccagtgaatcaactgctttatcttcaaagccttgattagtaacaacctttgattgatagcgtcctcatgtttagttcactcaagctggagggagagttgcattgagatgtcgagtcagacgtggtggcaagtggaagccgcaggtgattgacatggtttgcggtttaaccaggaggccagatccgctccccactccatatataatctcccctccacgtggaaattctcatacatgactcttactgaggcctacacattcccaatcgctctttcaagcacaagaggctccttagagagaaaaacagccagcactgaagaaggcattcatgaatttcatagaggaatctgagccgggtgccgctgtggattcaggggccacatagtggtcaggatgtgatggtccctgagtgggcattgcttggagctgatgcttggaaacctcagctttctcagtatacaaatgttaacacagctggtggttagctctttctcagaatttgagaaatgttgccatgattttgtaaatggagcctagattatgctaatgatggagaaatcactgagccaagaaccagaaaacctgcttctgcatggggaaaatcactttgtgggcaccagtgtcctcgtctgtgagatgggaggcacaggttgggtttcccacagcctcagctctaatattgcatgactaaggacatctccttttatttagactatctatgtgaatcgtcaccaaaagttgcaactaatgattctgaggctatgcagatgacattgatataagattttagcattgctctaaataagggaacacaaatatatcactttaatgcagtacttacatgttgggcacttaaatgctctatttatcttttttgaataatgagtgttatgttttcagcttaaactttgaccatgaaaacttagaaaatggacaaatgaaactagttactgtcagaattgcaaaagtggatcatatgcagtttccttctgaaaaagccaaaggaataggaaactgtcatttaaaaatagtataaaacaggaactcttttttttttttggtaaggtgggggtggggctgttttgcatatttaagcaagaggaatcatgactggctgttaaaatagcaaataaggcagaatttatttttgctttaaatttgattgggaagctttgggttagtgtatggcagaggtggtggtgcttttggcctgcaggcaagatctgtctcttatcttaatgttattttgaccaggggtggcaatttctggtgagtgctaccgtaagtcacaaaatgctattctctttgggtactcatcatggaagcttgcagggctagaattcaactgaagtggtttaggagtgggcagagtttatcaccagctggtcacagttgaaaagtggagatgaaagcagtttgaaattagccaggcttggtggtgcgtgcctgtaatcccagctactccgaaggctgaggtaggagaatcacttgaacccaggaggcagaggttgcagtgagccaagatcacaccactacattccagcctgagtgacagagcaagactccatctcaaaaaaaaaaaaaaaaaagaaggaaggaaggaaggaaagaaagaaagcaagaaagcattttgaagggagcagtggagagtaaattccagctgacctttgtctccagcacttggcttgctctccctgagccccctcaccctcttggtgtggcccgctccctttcactcacacagctatcctgagcacagccaggcactgtgtcaggagggatgagcaaacggcacatggcatggagtgggggacaggtgagttgcaggcaaagacagggtacagccctgggatatggcaagggctgtcagagtgggcaccgcatgctactttcagagtacatggaggaggatggagcgtagtagggtgggctagcaggtggaaggtgggcttcctggaggaggtcaccctgagagccaggattagccctgctagcttgggaaggggtgtggctgcagggatgggtcttcagttgtaggaacctcgtgcataaaggcacagaaaaggagtacacggggatgcaagtgggggtatatggagagaacagcttagggggcactctgagagacatggacattaaggaaactaggccgagcacagtggctcatggctgtaatcccagcactttgggaggccgaggtgggtggatcacctgaggtcaggagtttgagaccagcctggccaacatggtgaaacccggtctctactaaaaatacaaaagttagccgggcatggtggtgtgcgcctgtaatcccagctactcaggaggcttaggcaggagaatcgcttgaacccagaaggcggagattgcagtgagccaagatcgtgccactgcactccagcctgggcaacaagagcaa[450 bp omitted]catctctgtctggcacagtggctcatgcctgtaatcccagctctttgggaggctgaagtgggagggttgcctgaggctgggagtttgagcccagcctgggcaacacagtgagactcctatctctaccaaaaaaaaaaaaaaaaaaattagccaggcctgatggtcgtgcctgtaatcccagctactcaggaggctgagacgagaggattgatcgaacccgggaagttgaggctcaagtgagctatgattacacccaccgccctccagcctaggtgacagagcaagaccctgcctctaaaaaaacaaaacaaaagcaaacagagctcgtctctaaagggtacactctgaaacggacaggacttcttctgagctttttcaattcagagctagattctcaggccctctccccaacccctcactaaagccaagaagcacctgaaggagttcagcccaagtctggagatacttaaacctctcaaccaagtggctttcctggtgctgtccctgaagcaggtgtgaggcctgagttatgaaactgaggtgggttgcctggggataatggggatcgactgagcatttcagcaggaatgtgataggatgagacctgtgctttaaaagttgccccagccaccgtatacaaaaatgattagaaggggtgaaagctagagtccagggatgagggagggaggatgggcctgagcgaggtcagtgttgcctatcacaggcacatagaaatagagaaggaatgtgcatggggcagctgaggaccgccattgcgggcacggggttgaggtggctgatgaaattagttttgctgtactgggtttgaagtgccatgaaacatcagctagagatgggcagctagcgtggacaggcattttagtataggggtctggggctagaggcttcaaggaggctggtgctgcagacagtcatataaataggggttggatgaggtcccctagagagtgtgggaaggggcagaggacagccccagacagaccctaaagaaagggctgagagggacaagtcagagagcaggctggggacaccagaagcacagtggcctgtaaggaggaggtggggttgcagcgcaggcgacggagttctgacacgcagtcagagagcagggaaactgccacgggactttgcgacagggaagtctttgagaacctggctggacccttctcagtgacatggtttgggtggaagccaagcccttggcctctctccctcttcctgatccctagaaccctgttctctgcctgcacaggctcctccctagccctggctgactcctcttcctttttctttctcctctgctgccgcttttctctccatgcttccctgaccgctcagcatgcctcactcttgaaaaaaatgtgatttttctctgtacttaaatgaaaccatgcacttctcattctttttttttttttttttttttgagatggagttttgctcttgtcacccacggtggagtgcaatggtgctcactgcaacctccgcctcccaggctcaagcaattctgcctcagcctcccgagtagctgggattacaaacgtgtgccaccacgcccagctaatttttgtattattagtagagttgggtttcaccatgttggccaggctggtcctgaactcccaacctcaggtgatccacccgcctcggcctcccaaagtgcagggattacaggcgtcagccaccgtgcccagcctcattcttgttttttaaagtggttttcttctgtgatggaataaaatgaaataaaattactgagagaggaacttaaattattggtttttaaaaatatatggttttgtagacttctgtagaaacacagcattcttcgcctaccctcggagcacgtgctgtagctatgcatttgtgtctgtagctctgcagctcgtggggctttgtgaaacacaatgagaagcatctaaaaactgagtcaccaaaagtagcccttgcccccatttaagaccggtttgactgaaatgtgtattctgaggtcagtttggtgcctggaatgcattccccaggttttgctgaggttcccatctcaggcctccacccagcacagctctgcagatctcaccctgattcagcgtcaccccaggaaatggtgtgtctgggctccttggtatggtttctaaggcagctcctctctgccaagcagcagcctgacaccctgcccaaggctcagagggatgccacagcatctccggggctgccagagggccgcccaccctggtgcggaagaccccacccgagctcctgccatagttgctgcctcctggcctcttcccctccccacatcaagacctgttccttggagatgaggcctgcagctgacagccctccagaggccctgccccagtagggctcagagcccatgtgcacaggcagcattccacctaggcaggccacagtccccgggaggtggccacacagggtccccctgagccatggctttctcagccaatggtctgcccagccctcctcactcataatcaagtcctctcatttcttcttccaaaatagatctccctcctccaggtcaccattgtctctcatctgcactattgcagttgctgctttttttttgtcttttttgagatggggtctcactattttatccaggctggagtgcagtggcttttcacaggcatgatgccactactcctaagcacaggagttttgagctgctccgcttctgacctgggccggttcaccccttcttaaccaacctagaggtcctccactcccaggagtcaccatattgattccgaacttagtgcagacaccggatgggcatagcaaagtgcagcccagagctcctgggctcaagccatcctcccacctcagactcccaagtagctgggattacaggcatacaccatcgtgccccacagttgcttcttaactggtgttgtccagtttggcaaacagaagaaattcaaggtatacagtcaaatttggattttggataaacactagcttttaacagaagggtgcccatgtcttcccaggcagccctgctcctaatgagcctccctcctgtctctttggctaccctctttccaggctccacaaagtaggcagggacaattggatgcttttaaaatttttgcctttttaaaattgtggtggtaaaataaacacaaattacaccattttaaccatgtctaagtttatggttgttggcagtaagaacattcacattgttgtgaaaccatcaccaacatccacctgcagaactctttcatcttcccagacggaagctctttgcccactcaatgccagctccccgcggccgcttgctagcccctggccacccccgtgctgttctcggtctctgtgaatcttacagactggatggttttgcatccctgctcagctccgttcagtgggtccccaccacacccagagagactcccaacacctgtgcatgtgactgattcctcagcactgagcccaccacgctcttccctatcccagtgcctctccagagcccacttcctggaagcgctcaccctttgttctgagccacaccacacctcttatcaacaggcaccttccctgaccttccttctgaagcagttccatcccaactcctgcttactccattctcctcagtctcggtccccgcccatttcttccatagcgtgtactgcaatttgaattttttgataagttcttctttacctttttatccccagcacttggtgcagtgccttgtatatagtagatgctcaaaaatgcttgttggatgactatactggccacttaaaatggggattgactatattccgtttaaaacaataaattctttattctctgcttcatacagctctgaatgagtaactagaagaacatattttttgtgtgtttaaaaaaattttttttaatatagagatagggtctcactacattgtttaggctggtcttgaactcctgagttcaagcagtcctcccacctctgcctcccaaagtgctgggattataggtgtgagccaccgtgcccggccagaacacatgcttttgaaaaggttttctgagtcattattcaggtgtatttaaccataaagtattttcttcttccccttcctctaactataggtttactttcctgtacaaaacttacttcattggttgaaataaaagtgagaaaagaagaaggaagtagaatacaagtatctgggcctgtgggaaaaacaaagtgcagctttgttttgcattccttgtggcataaagaacaccaggaggaatgagaaattataaatgaagtatttgacattgaagccaacggcagatgcattctgcttaatttggagggaaaaaaccccacaactgaacaggtttgtcctcccccagtgtcatgcagggcctctcgtggcctctccctgggcgctgaacagagccctttctcagcacctgttggcagaggttgatgctagagttcccagggtgatgggctggcggattcttaacaaagtcaggatttccagctcttgttcattttccacccagcgcccccagtgtctgtaacatcattatctggcaatgttatatgttacagagccaactacttgcatgattattaaaattacatttatacttcaggttgagtatctcttattcaaaatgcttaggtccagaagtgcttcagatttggttttgttttttttttaatcctcagatttttgaatatttgcattatacttactgattaaccatttcaaaaagttttgaatcttggagcaatatggattttgggtttttggattaggtatgttcaacctgtagtattgtcaatggaaccaatggtgtgctgaggtatttttgatgcattacaaggagctgtacggcttgatcttcttttccatttccagaccttctacctcccccacccaggacccccagctttggagtccacgccatcagactgtgccagtctgactcacttcactgctgtggtcctcggatccccgaacactcctccttgctgtggtcagctccggctggcttgctgttcccagcacagccctgtcatcattccatcatttgtagccatccccaccttcaaatgctggcttctctgtgtcttgacttcctcccctccaagactctgtcctctcccctcgagccactctgcaggctgaccaattctgctgctcattgcttcatttgatcgtttccacttcagccattgcctcccttctgtccactcaccctcctgcagccgctccagcccctacagcctcagcctgtcaccagcacttcccgtcccttgaacctgcctgtccctaccgcccctccgctcctgcttctcttctctcctcccctagcttggagacactcattgcccctcccccatgtcacacgcacctggtaaaatgccagccctatggaagtccgacccttcacctattttgccctcatgtccacacaacagctgtgacctgcactgagatgcctagcagctttctgcatttccagttcaagagcaccagcctgaggagcctcatgaaccccgacatgtgcccagtctgctccctctcactgcctgctagaaacaatgccccaccttccctttctctgccctcaaaccttcccctacttgcctctctctgtggattccctgctgtctctttccctgagacaagagaagctgccagccaagagccctgacatgcatcaggtcttgtgctctcttgctgtttcaagacactgttctagaaattccgcattagcgttttccctcacttctgcacttcccataggaatcaaagtaaagccttcactttcccctacatccctctccagctacctcagcctccaggtgtctcctccccctgacaacagaagtgttttaggaactatgctcagtttcccccagttcttccccacccgccctctcttgaacctcccacccctcgaccccagcagcacaagtcagcagtgaccctcaggacactacatccaaagggcacccatctctcagcatcttcctagctgcccaccagcagggtctgctattgtcagtctcactccctcatggcacgttttcctcatttggcttctgggacactgttctctgcttttccttccccctcaccagccagcttctcatttgcccagtggttaaaccttgcaatgtcccagaactcactctttcaacctattttttctccacactaagtctcctaagtgattccattgaaagcattgtattaatttcctggggctgtcagggcgcttaaaacaatagaaatgtattttcctgcagtcctggaggccagaagtctggaatgaaggtataggcagggctgtgcttccaggttcttgggaagaatccttccgtacctcttccagcttctggcagctccgatgttccattccatgtcttgttgaccgcactgctcctcttcccacctctgtcttccggtggcctctgaccttcctctgccttctctcataaagataccagtggttctatttagggcccaccctaaatccagggtgagatttcattttgagatccttaattaaatctggaaagactctatttccaaataaggccacattctgaggttccgggtggtcgtgagttttggggggacattagttaatccagcacagctgtctagactccggccactccgaagcttctagctcagcccaaactgctcccgtgagcccctgctggctcagcatctgcccaaagatgtgtgttgggcatgtcaaactcaatgcaccccaactcagtgcctattacccccttttccaaaacctgtgccagcagccatcttctcccttttgttgatggcacctctgtccttggagctgtcagatcccaacactcaaagtcattcttgaccctcttccttttacattgtatatccaattcctcagcaagtctggggttctaccctcaaagtagattcaccttcctaagtcctgcacatggtcactctgacccaacttgaatacacactcaaagtgagtaatctaggagctggctctctactcctgtgctcagctgtggcttcccccagcccagtggtcacacagcagtcagagcaatgctttgaggcataaatcagataaccccctcactctcagccctccagttcttcttggcttcactcggaatgcagggggaagcccccataaggccatttgcctgcagtgtgtgtcagtcatgatgtagatttgctttcagaagttactccttttcatacattttttattgtcttatttgtttggaaatctatgtttcagggtttcatgtgcttatcattaaattcaccttggattcttgtttaaaatctgcaggtgtctaggtaggtccctctcactgttagcagtcattaaggactagggccctgaataagccgcaggggtcctgtgggcttcaatagtcgggaaacactgccattgagaagttgctgaaccgagcaagtgatcctttttctaggtcacgcatcttgcaagggaatgctgcttttccccattagaaagctgcactgctggggaggaactgtacttctctcactgctctaagtgagtgaaacccagtaattgtttgctgaaatcactaggcatggacaagtcctacctggtgagcaaaatgcttgaccttgcttcttcctcagcttcggcccttgcagccacacccacctgctcttgcccccacatccttaggtaaaggaaaatgcaggagcagccacagagagcagacgtcacaggcttccctcgcaaacacatggtattttgaaaacgcacttcaaaggggttgaaatataaataaagaggatagcaaatctgtttcaggtatatttggaatttgttagatcttgttacagatttcctttaagtttgtcacaggacaaataagtcagggattgttttcggagcccaggcgctgtctttatacaggaattcttttcagaataacacacatcaagttctttaaggtattttgtcttagttgaaatatagcacagctgcctgctatgtattttcttcttctcagctatctgacatggtgtatattcatgtgctggattattattttctgtcttcccccatcaaagagtaaactctgcaggcaaggactgtttagtggacctgcaactgggtggggcttgtggcatacaggcaggactgtgtgtggttggatggaagggggaatgtcagttctcgtaagctaatggagataccttgaccttcagtcttttaatatactaagggtgaccaggctcagtggctcatgtctgtaatcccaacattttgggaggctgaggcaggaggatcagttgaacccaggagttcgagacccgcctgggcaatatagtgagacctcatctctacaaaaaaataaacaaaattagttgggtgtggcagtgagcacctgtggtcccagttactcaggaggctgaggtaggaggattgcttaagtcctgtaggttgaggctgcagtgagctgtgatcctgccactgctctctgtcctgggcaacagagaccctgtctcaaaaaaaaaatccaccagaatcccccccgcaaaaaaaaacgctaccttatgtatatgctaagggagtagtcatggcatggcatcctagtgacattacaaatagcagccatatccctttacattcctgccagcagtgtgtgagatttccagtttctccacatcctcactaacacttgttattttctgggttttgataatatctatcttcggggtagtacagtgagttttgaaatatctatcccaaagacatagttcagtgagtttttgcaagagaaagtaaatgggtattcattgacaaacttttcttcctgttttctaaagaaggtaattctgtttcgtggacacttaatgatttaaatatgggtatttggtgaagctgtcattttgaaaatcatctctccctaaggcattgtgggtccttgcatgctgacagattgactagattttgagcagtcacagaaatctccaccagccctaagcttggatatgccaaacactgcctcatctttgagctatgaaggtagtctaacagactgcaagctttaacttgactgtttattatgattattattattttagagacaggatctctttctgttgtcctaggctagagagcagtgatgtgatcatacctcactgcagcctgaaactcctaggctcaagcgatcctcctgcttcagcttcccaggtagctgggaccacaagcatgtgccactacacccggctaatttttaattttttgtagagatagggtcttgttacgttgtccagggtgttctgaactcaagtgatccttcctgctagtcctcacaaagcactgggattacaggtgggagccgccacattcggcctaagttgaccattttttaaattatctgactttcttatttctttttgcctcttttttttccactgccaacttggtgagcattgtatttttagaatagaataaaaagaatcttttcttgccaggcgctgtggctcatgcgtgtaatttcagcactttgggaggctaaggcaggcggatcacctgagatcaggagttcgagaccacactggggaacatgatgaaacaccgtctctactaaaataaaaaaaattagctgagtgtggtggcgagtaggtcccagctactggggaggctgaggcacaagaattgctcgagccccggaggtggaggttacagtgagccaagatcaggcactacactccagcttgggctacagagtgagacttcatctcaaaaaaaaaaaaaaaaatcttttctgtttatttatttattttgagacagagcctcactctgttgcccaggatggagtgcagtggtgcagtcttgtcttgcaacctccgcttcctgggttcaagcctcagcttcccaaatagctgggattatgggtgcccgccaccacacctagctaagttttgtattttagtggagacagggtttcaccacattgggcaggctggtctcgaactcctagcctcaagtgatccacccacctcgtcctcccaaagtgctgggattataggcatgagccaccatggctggctcaaatcctttctttttaaaggaaggagccaatgtggatgaatgcttaagagcacagactcttaagcctggaccagccagactcaggttggaatcctggcctttctagggaaattgtaacctctccaagactcagcttcgtcctcgttactatgaatataacctactttatgggcttattttaacgactaacatgcctagcacagtgcctgggcaagtagtagctaatacatggtagcaatcatcatcatcatcaaagtatagatttcactatttcttagcagttatacttggaaaaggagattattatgataaccaaataaagctaaaataaaatttccaagaaattttgatcccaaaaaagtagagtacaaacaagaatgcatgagctctctgttccatccctttcctccatccaaattatggattggagattagaggaatctagtgttggggaatcaatgaatattaacaagtagaaaagtgtttctgtgacaactgttgagaggtataaaacaaatgctgtcatatttgcagtacagacaagttgagttcttaaactttttgcaaactccctggtgtgtgtgtgtgtgtgtgtgtgtgtgtgtgtgtgtgtttacatcctatttttttgttgttatcattaaatggtctttttaggtcagtttgggattgactccaggggcttcctgttataaaaaaatcctttagagagactgtaggttttactcaatttctacttatttttcagttccaacttattaatattgttattttataggcatcctagggcttttgaacatcattaattatgtgaattcttctttttctcaagcataggaagacaatacatccttagagagtaaggtaaacagtgtctactaaaacaggtaaagcaccaggaaaatcagatcttcatttttcctactttttgacaggtttctcatttaatttttctcactgcttgtctagatgacaaatgttttccaagcagccaattctaagacaggttgcgttttcagttccagtttctcatttaggctggaatttcctggggtagtttttagctttgcttgagagatcacattcagcccctcagtgaggttcctttgatcccttttttccctcagtcatctgacagaaatgggggttcttctcattaaagtgaaaaaaaaaaacccaaaaaacaaaaaactcaccgagcaagatagccttgcttgtctttgccaatttctcaaaaagcgatagtaattaggatgaacagaagagcactaaagcaagatttccagagtgaggtcatccacagaacacttcattatttgtccaaagcattgctcatgttctctggtggtagcagccgggtatgtgtgctgagcaaacagtccacagggcacatgcccagcaaggctggtgatggctcagagcctgcgcctcgggtgggagagagcttgctggaagccggtttcaccgtgtgggatgctggggttgacagacttctcactgggcctttgagaaaagcgggaaagatgaatgacctggatggtcatcactaggaagctactaagcaggggcattatttgagctctgcttggatttgtaaaacataattgagattgtgctctctatcaaacccgcataaaagaagtccatctgatatattacctagggccttggtggttaggaatttcccatctctggtgtggtcataggcaacccacttctcagtgggtgtgtttgatgacacaaaaccgcagtgcctcatgagggagagcccggttgcctttcctcgagaaggtccaggcaggtgcatttggatagggcttgctgagcctactcacatggacactccccattcaggaaatagcaacttggactttctactttaacattgttagaggagagggaatttaaatgagtgcattccactcaaatgtttctaaaactttggtctcatttaaccaaaccaaaaaccatctgagacaggtctccatcaatttagaggtttattttgccgaggttgaggaccatggctcatgacacagccaccagagatcctgggaacatgtgtccaaggtggctgggatacagcttgatcttacacattttagggagacagaagttataggcaaagacataaatcagtacacagaaggtgtacattggttcaacccaggaaggcgggatgtcttgaagctgggaggggaggcttccaggccataagtggattcaaaaatttcctgattggccaggcacagtgactcatgcctgtaatcccagtactttaggaggccgaagtgggtggatcacctgaggtcaggagtttgagaccagcctggccaacatggcaaaacactgtctctactaaaaatataaaaattagccaggcatggtggcggacacctgtagtcccagctactcaggagactgaggcaggagaatcgcttgaacccaggaggtggaggttgcagtgagctgagactgtgccactgcactccagcctgggtgatagagtgagactctgcctccaaaaaaaaaaaaaaaaaaaaaaaagtcctgattggccattggttgaaggagttaagctttgcctgaagagttgtagtaagcttgagttaaggtataggaagtggtggttgtagaagcaaaggttcttatcatgtagatgaagacttcaggtagcaggcctcagagagaacagatgtgaatgtctcttatgggaccttaaaaggtgtcagttaaatctctcctggatcaggaaaagacttggaaagggaatgggattctctatagaatataaatttcccccataagagatggctttgcagggccgtttcaaaatttgtcagagaaatatattttaaggtaaaatactttgatcttctttagaacctgttatctgtcatgtgatgttatactaaagtctggttggaatttggtatcttattgctgcaaagagtctgtttatcagtctcaggatctctattttaatgtgaatgctggtcattggtgtctacactccaaaagggagaagggcataatgagtcatgtccaattcccccttctcatcatggcctgaactagtttttcaggtttctttgaaatcccctgggccaaggggagggtctacccagttggttaagaggcttagaattttaattttgttttacatgttttaaacctcataccctggggaaaaagttatttgcaaagtaaataggactctaaattttgtattctgtccccactctgcccagcttaagtgtgtgcctatttaagggtgtctgtgtgtgtgaaatcatactagagatgtgaatataccaacaaatagagacacgccggcagtactaccacgtcaacttaagcagctgtgtccatagtggcctctgagatgctgctcggggtctgaggtctatccctgatcccactctgccaccagccctgacagctgggttgcctccacctggaggaagtggcaccttttctcacctgctgtggccccaagggtatctttgttgaagggttgacacttcctgtttcacaccagcagtgggggagaaagtcctgcccctttggggtcagaacgttgggtaagaccttacttctctctttctctggtccacttgtgcctctagctgcctcaaagccctgacttatggaaggcatctgttcagctgactggcagtggaggaagaggcagacacttggtgactaactccttttcttctcattgtatgttacaaaggccactctagatgactggaagtctatctatccagccaaacaagataagcctgcccattaactcaggaagcattattattaatatgttctgtgcacctagacttttcattgtgtacaagatgccaagagtttcaccagaaccccccacccccaggatttgctctctgacccagtagttctgtgcctcctcccaggacagcagtgggctcagcatggtcttctttgtcatcagcttcaggcacaggcgttttcaggaaacaatcaccttgctccacactcagagttttggtcatggtgcacccccacatgctcccttgtccctgtgctcagtaaaccgctttttaaaaacgaaaatgaaaaacacagaaacagcacaggtagaaaataccatcatatgttttcactgaaggcaaaaaaagaaactaaaaaatgtgcattggccatgctatttgaatcaaagagcacaagaagcatcagcacatctcagcttaagtcaagagtatggaaacctcactgacatcgtctctttacgtgattagtctcatttttggtaatagggatgctttttatttcagatttccagtagcttcacacatcaactttctgagacagagttagacatcagcactgggtgaaagagacagtttaaattagttctttggtgtcggcaggtggtttagaaagttggggttttcttgtctttgttcacccctgggcctgacattataatgaagagaatcacatggcctaagatgaagagaatctcctcatttggtttagaaccaaaagattttatcggtttcccaagctctgtgagtaatgtctctgggcccagagctgtgatagagagggagaggagctgaggcctgaccctgtatcccctgcctccaagccatgaggcccacagggtcctgacctaagttgcaggaaaaacaagctcaagccatgtgttccaaacagttgatgggctaggaattcttccaaggtgtttggagaaccttcctcacctgccctttccctcaccccagctccatatggagcctcctcctccctgcctgggctccttatgctggccctgcacatcttactccttcttttgttaagctgagttgcatctggacttcctccccaaccattatgatggtaacagtctacctgtgaggttgctcaaaggcaacgtgttgagactaagattttgttgcaatcctaaaatagcttaagctttcaagcctatgatctagtgctctgcttctcaaactctaagctctggaggctgggaagtccaagatcaaggcgccagtagatacagtgcctggcgaggtacttctttctgtgtcctcacatggaagaaggtggaagggcacaaaaagggtcaaactctctgtgaagcctattttataagggccttaatccaattcatgagggaggatctctcatgacccaatcacctcctaaaggccccccctcttaatacgattgcattggagattaagtttcaacatgaatttggagggacacattcagaccatagcatcatgcatttgcagtgggggtaagattgcccccaagggagcaaaaattgatcccttaggggtgataaaaatcttagatattacaatagtttgtggccctccaaagttcatacctacctaatacaaccttctttcctcatgtttaatttctcctgttaaggatgccttaactttaaattttaattttaattcagtaattcttcctggaggaataataatgaaaaaaaagtttgagaaacaatgttctagacagagacaacctaaacaaagttttgcatgtacttcctgaaatgggaaccagaacttggcctggggagagcttgtgattccctttctgaggggtgaaatttgtacttaacaacaatgagaggaaacctcagaagtctctttttatcttctcagagaagaagtactctctcaatgaaatctttgggttccagaagcatttagttatgagtactgagctctcttggtactgagctctcttgtgggtctgacattctggagtgtggtgttagaatcgtggactttgaggtcagacacgcctggtgtaaatgggagcattccccttcactctgcagctttcaactggttctttaatttctcaaagcctcatttgcatctgtacaatggaagtaaaacctacctggtcaatttgctattaagatgaaacatgaattgagtgtaaaggatgtgaagcagtgtttggtgtatagtaggtgttcaattagtggtggggaaatggtggttattaatatccatctacctacccacctacctatcatcatcatcttagtaaaatgtctgtgggcacaaaacaacacaacaatcttctgaatcaaacacatcctcttctcatcaagcttgaccaactccatgtaactcccacagaagtcaagctttccaagctgctggaacaataggaagtgggagtccctggggacagctgagccttggtttatgtatttatgtgacagctctttctgtagtgctgaacgctacatggccctggaagaggaagaaggtattccatgaaaagttgacactacattcaatcagccaaaggagtctctgatttcttcctgctgtttgaaatagagctggatttacttagccgtagtaaatagaccaccttcaacaacaacaaattaaggttttaaaaaaaataaaccaagaaagaacaatacacaaagaccagggaaagaataaagagaatgaattaattttatataaagggagaggtgtgatatttatcatctgaaaagcaagtcatatctgagagcttttattttgctcccatattcattatttattcaacttggctaatgctgttgtttctaatcctgtcttggtgaacgctttaattactgtttggaatctgagctccttaaagcactctggcatggaaaagaaggccaaaatacactaggtttgttgcaagtctgttattatttctgagaatcatttttttaaatgcactcagatttatgcaaatgcgggatgtgggtaggtgtgacaaatgccttactaacaagtccctggagtgctttttgtaatgagttgatcatcacgtgtgtccttgctgctgtgtgggaggctgggtccctgccatcatgcccacctgtgtggccgatcaacagcgttgggagaggggcagcacaggttcctggttgctattgtcaactgtggtttcaggcccaatttgggacttcagccagctttggcttctttgggttcttggcccagtttatatataattattggaatgttaggtagataagtgtctaagagctaagaatttttaaaggctgcactaccatggagtggagccgggaggctgggacagagtcagctatgaccgctcaattgctgctgtctcatctgggctcctgtaaccaactctggtctgtttgagccaggcatcgtggttctatcgccaaaagcctactgtgttataatcgtacactcctttctttcacacatgctcagcctgatcttcgctctccacttttcccagttttactggctttttctaacaagtcttgttgaacttgggttaccagcagacaaaaggaaacagaggcagggctcctctctcccagccgccaccaaaattgccaccccgtgtcatctgtttcagtagtgcccactctagaaggagctatcctgaacttcctgacgccctcaccatgccactgcctgctgtttctgggcagcagaggcttcctagagaaagtcagactcaggagctctgccttcacctggttatcaccactgcccaccttctgttgacttcccatcaaggctgtttgaatcttttccagggtcaggtaaaagctgtgcatctccccagtgctcagggtttgtgacagttgggagaaaggcaggggacacgaagtcactgctctccaaacctgccctgtccttttcctactgtccgtctggtttctgctccactcagcctctgtcccacttctcaagtccctcatgaaatgaagcctcctgctgtgcttagtgctgtgctgtgctcagtgctgggatgggttcatgttcctgcagaaattgtggacaggtagtcaggtgaggagcagggagcactggggatgcatgcacacctggcaggagagggtatgccaggcatggcttccgggagaagtaaaatctcagctgagacaggcaaactgcataggtcgggtgaaaggggcagggagggaatgagcgttccacacagaggcagggggtgtagaagcacaaaggagggggtcgtggtgaggaggtggagggctgagccggggccgggtcatacggggccttggcagcagtgcaaaggagcttggaccacattctttgtttccactcggaagtgaaatactggactgaatagtctttgagactgatgtaggccacactgattattttacttgagatttttgtgaccatgagaatatcatctgccaaatccctgtagtagtgggctaacaagatagtattctggtcatgtgaaaaccccagcccatttcccaaaggacttactttgtctctgataagaggtttggtgacaagtttgaaggctccaatgtatacaagtgagaatagaaaagatattttcagccctagaggtgtttatcaactggctaacatgacaccactgagagcattaaacagcataaaaataatgacaaagctgtgatcagcagctgcagatggtttttgtacacattgaccatctagggtgagtaaaggggagttcagggaaggcccacggggcagaaggtgaggccagggattggcctagaggggaagcaaaggcagacccaataccaaggagctaatcttttgctaagcaacgtggtctggaactggcggcctgaagtgcttgattaccagggatactgttgcagatgactggggaaagtcagatcctccaagccgagccacctgcaattcaaggtagaatctggcagaatacattcattcctgtgtgaaaaattcgaatcagagttttctctaactgcttaccagataaactactacttggctttctttacttcttgccctttttcttgcttcttacttccctcctttcctcctctctccttgtttccttccttccttcatttccttgttccttccttctttccttgcttgctttcttccatccttccttccctccttcctttcctttcttccttccttctccttaactttataatttggtaatgtcttccttaaaaacctgactttggaacgatactacactttctattcagcaacgagtagtagttttgcctccctatgttattgttgtgtttaaatcctggattctttcctgctgtcatactttgtcatgagagtgaatcttgccgggcgtggtggctcatgcctgtaatttcagcactttgggaggctgaggtgagtggatcacctgaggccaggaatttgagaccagcctgatgaaaccccatctctactaaaaatacaaaaactagcatggtgaaaccccgtctgtactaaaaatacaaaaattcgccaggcatggtggtgcgtgcctgtaatcccagctactcgggaggctgaggaaggagaatcacttgaacctaggaggcgggaggttgcagtgagctgagatcatgctactgcactccagcctgggggagacagtgagactgtctcaaaaaaaaaaaaaaaagagtgaatctttgtgattgtcctggagggaatgtgcagagagaacttggagagccagttccatgggctgttgattaacctgacagaaacgacatcctgttcttgataccttaataatttatttgtattagcatgtcactttctccaactctattttcatagttggttcaggctgccataataaaattccatagactgggtggcttaaacgagagacatttatttcccacagtttaggggcaaggaaagccctggcaggtttcatgtctgatgaggggccatttcctggttcatagatggcaccatatagctgtgtcctcacgtggtggaaggggcaaggcagctctctggggtctcttttacaagggcactaatcccattcgtgagggctccaccgtcctgatctaatcacctgccaaggccctgcctcctaatactattgcctcggggttcaggattgcaacatttgaactttggggtagggggcggggaatgggacacaaacattcagaccatagcatctgttttctgatttgagaaactggcataataacatctatgtatctacatggatgaatttagcagggtcttgaaaagattcttcacacattagaaaatgttaagacatggccaggcgcggtggctcacgcctgtaatcccagcactttgggaggccaaggcgggcggatcacgaggtcaggagatcgagaccatcctggctaacatggtgaaaccccgtctctactaaaaatacaaaaaattagccgggcatggtggtgggtgcctgtagtcccagctactcgggaggctgaggcaggagaatggtgtgaacccaggaggtggagcttgcagtgagccaagatagcgccactgcactccggcctgggtgaaagagcgagactccgtctcaagaaaaaaaaagaaaatgttaagacatgttcctttttttttttttaagatgaccattgttggagatttggcagagggtggtcagttattttagaaagggctcaaatggtgattgccattacccactgtctttaaaagctgaatgatcaaaatagtatacatgaaaagatttcaggaattcataagttttccggttttccttgatggcactttccagtcacctaccctacatatgaaaatgggagcctatttctgttttcagattgcagagggaatggcatacatcgagcggaagaactacattcaccgggacctgcgagcagctaatgttctggtctccgagtcactcatgtgcaaaattgcagattttggccttgctagagtaattgaagataatgagtacacagcaagggaaggtatgttgcactaatgatctttagatgttttattattgtgttttattttgtttttgtctgtttttgacaaagcaattacaatagtcaccattaagaaaaacttatttggtacaacatttaagctgtaccataattgtctgcttatggttctattctaatagtttctagaaggtactctcttgattaactccacatgatacttttgttaggcttacaaatgctatcagttgtatttcaattaagcaatgcaaaacacaaatagattcagcaagatgattcttgtttattttgtattgttaaagttttcactcaaacaatgaatataatatacggggctgtggagaaaatatttgtaacattaattctatattgtttattccagccttttaattacaaattaaaacatgaacattaccatacacacagaactaaatataatgcaaaaaatctacttctttattttcccacattctgtattatatatatgaaccaaaaatgcacagagaggcctaagttccccagcctgtggcacattgtcagggggccaagcatggtcgggactgcagggcctttcttgggctaggattgcccacgtggttatgactgaggattcttatgctctcacccacgagagctgagcaaatatttttgcagtgctcactgtcttctggaagagacaagcactttcttgaaattcctaagcattgttgaacaaggattattattattttattattttgaacctgggaggtgaaggttgcagtgagccgagatcgcatcattacattccagcctgggtgacaagagtgaaactccgcctcaaaaaaagaaaagaaaagaaagtatggggtcacatgttcatgacttttttgtttaagtttaaatacccaagtaagaaccacatatcttcttccttaggtgctaagttccctattaagtggacggctccagaagcaatcaactttggatgtttcactattaagtctgatgtgtggtcctttggaatcctcctatacgaaattgtcacctatgggaaaattccctacccaggtatggtttacttagctatttacaatcaagctgtataaatgagaaaaagtcaggttgcatgaaggcattaaaaagtaataattacttcatctacccgatagcaaagaataagtgctttgagccagaacttgattttcacgggctgggcatggtggctcacgcctgtaatcccagcactttgggaggccgaggcaggtggatcacctgaggtcgggagttggagaccagactgaccaacatggagaaaccccgtctctactaaaattacaaaattagccaggcatggtgacgcatgcctgtaatcccagctactcgggaggctgagacaggagaattgcttgaacccgggaggtggaggttgcagtgagctgagatcgcgccattccactccagcctacacgacagagtgagactccatctcgaaacaaaaaaaagacttgatttttattttcactatctttagcataaattgttctaagagtgcttagacacttctttgcctccttattttgagtgtgtgttcttgttctgcactgattaattccaccacatactagaatgttccgggcatggttgttggtgtcgagatgaggatggatagacacaggggctcctccaaggcagtccccctgactggaaggaggaaacccacatggagacaaggatttccgatgcttggttttgtaataagtgccctggagtctctctctcttcaagaaataaccacctttgtttatcagtgggaggcccttctgctctttaacatactggtatcagtgagggcatcattcagtatttatttccagattcctaacacctgaagcctgcagagccagattctgaccatccctccatttttccatggtctgtgctggcatggttaagaagagggatttcggccaggtgcagtggcttacacctgtaatcccagcactttgggaggctgaggtgggtgaatcacgaggtcaggagttcgagaccagcctggccaacatggtgaaaccccgtcattactaaaaatacaaaaaattagctgggcgtagtggtgggcatctgtaatcccacctacttgggaggctgaggcaggagaatcacttcaacctgggaagcacaggttgcagtgagccgagactgcacccctgcactctagccatggcgacagagtgagactctgtctcaaaaaaaaaaaaaaaaaaaaaaaaaaaagagggatttctcccagagccttcatattttcatttatgtttgactattaacaaaatatttgcatgaggggaatttaaaattaaatttttaatgtttaaatctttctcctattcaaaaaatatttgagtatgctaggcactctcagctgctaggatgccatggtatctgcccatgtccttgagagtgaatattgtagtggggagagactgatgtttatcaaacacacagccatcctgtagggtggtgagagtagtgtggagcctgcgtggagtggcttagggattggcgagtactcacagaagggggtggggagctgctggttttattccatggtcctggcagcagcagggactcacagagggagggagtcttgggctctctgaggtctgcatgtccccatggggagagcagccagagcatgggcttggccaacaggagcaggaggccagcgtggtttgggcctctgtgagtatttgatggatggatgggtgaatgaatgaatgaatgaatgacgcacctaggccatttgatctctagacagtcgatggatgagaaagaaggctatgtagctgggggttagagtggctcagggagagacttactggccatgtaagagcagcccctcttactctgctgagatgcaaaccagggaaggcttttggacagagcagccacacagtctgcgtgctcccatcactactgtttcatgtggggatgagccacagagaaactggggcagggaccagttggcagctgaaagcctttgggtggtgtctgcctgcacagtggaccggctgtcccaggaaatccctttagtgccagcatttcatcttccagctgctctagacactgagattaatgaattaacattgctgcaaaataggaaaaatatttctaatcagccccagtgtctgatgttatatatctctatctccatctatgcctacatctctttctataatctgtctgtagagaaagattatatagtcagattatgtatataatctgacacctgataaacatacaatctcataaaagaatgttttgtgatatgcgtggtgtgctgcatgtgatgtgctaccatggcccctgaggcttggagaaggtgattgggcccctcgctggtggcaaagctgctctgagccccagatccatgtgcctcccaagacccctcagccaatgtgcacaatgcccaggatttggaaatatttggggtgaaaaatcattttttgaaaaaagaactggctgggcacggcagctcacacgtgtaatcctagcactttgggaggctgaggcaggtggatcacctgaggtcaggagttcgagaccagcctggccaacatggcaaaaccccatctctactaaaaatataaaaattaggctgggtgcagtggctcacacctgtaatcccagcactttgggaggcccactttgtgggcggatcacaaggtcaggagatcaagaccatcctggctaatatggtgaaaccccatctctactaaaaataaaaacaattagccaggcgtggtggcaggcgcctgtagtcccagctactcgggaggctggggcaggagaatggcatgaacctgggaggcggagcttgcagtgagctgagatcgcgccactgcaatccagcctgggtgacagagcgagactccatcttaaaaaaataaaaaaaaaaagaataaaataaaataaaaataaaaagtagccaggtgtggtggtgcacgcctgtaatccggaggctgaggaaggagaatcgcttgaacccaggaggtagaggttgcagtgagccaagattgcaccactgcagtctagcctgagcgacaggaaggagactccatctcaaaaattaaattaaattaaattaaattaaattaaattaaattaaattaaaaaataaaaagagaaccagtagaaaaatggtgagaatcataaaaatatgtttctctctatatggaagaacacaccagaatccatcgactagtctgttccctgattggcttgtccctggaaggactggggatgtgagatatcttcaggagatcgggatcagtaaattttttagtcacgagagttgtatgttacgagagcctctagcattagggttataaacataatcaagcaatcctatttacttcacatgagaagacttgattcatagcacagaaatcggtaaacattgccaaaatatgccattttccacacggttataaaactgcatatgggagagaatccacgatgaatggaattatctgaaagtactttctttacgcagtaaactgctggctatgtttttgttttttgtttttttttttttttgagacagaatctcgctctgttgcccaggctggagtgcagtggcgtgatctcggctcactgctagccccacctcccgggttcacgccgttctcttgcctcagcctcccaagtagctgggactacaggtgcccgccaccacgcccagctaattttttttttatttttactagagacagggttttgccgtgttagccagaatggtctcgatctcctgaccttgggatcctcccgccttggcctgccaaagtgcttggattacaggcacgagccacctcactcgacctgtgttgttcgtttttaaagtactttagaagctatacaggccaggtgtggtggctcatgcctgtaatcccaacttgggtggatcacttgaggccaggagttcgagaccagcctggacaacatggccaaaccctgtctctacaaaaaatacaaaaaaaattagcccggcgtggtggccaacgcctgtaatcctagctacttgagaggctgaggcagagaatcgcttgaatgcttgaacccaggagacagaagttgcagtgagccgagatgcgccactgcactccagcctgagctacaaagcgagactctgtctcaaaaaaaaaaaaagaagaagtcatatcatatacttagctttgtaaaataaaaaggaaataaaagaaaggaggaaaaagaaaaaagaaagtcacatataaggcaaactcatttttagaggagatagaaatactaagataatatactgaaatgttagcattgggtcaagagataataggttatattaattttcttcttgatgaatttctgaaatttctaatttttttacaatgatattgttattaaatattttattctttttttttttttttttttttgagatggagtttcactcttgttgcccaggctggagtgcaatggcgccatctcacctcactgcaacctcctccttctgagttcaagcgattctcctgcctcaccctccctagtagctgggattacaggcatgtgccaccatgcccagctaattttgtatttttagtagagatggggtttctccatgttggtcaggctgatcttgaactcccgacctcaggtgatctgcctgctttggcctcccaaagtgctgggattacaggtgtgagtcaccgcacccggcctaaatattttattcttatctaagtaatatatgcacattaaaaaagtagtacagaaagacttcctttttttttttttttttgagacagagtctcgctccgtcacccaggctagagtgcagtggtgtgatatcggctcactgcaacctccacctcccaggttcaagcaatgctcctgcctcagcctcctgagttgctgggactacaggtgtgcaccacaatgcccagctaatttttgtatttttagtagagacggggtttcaccatgttggccaggctggtcttgaactcctgacctcaggtgatccacccacctcagcctcccaaagtgcagggattacaggcatgagccaccgtgtgcagccacaaaaagacttccaatgaaaaattccccatgcctgcgggtgctcctcaaagtaatctacttttgggaattttgattccttattctagcgtttgctgcatatagttctaaatattctactcataacttttatctcttaattaagttttttccacttattattagataaggatatggccacatacttttatttttcatttatttatttatttgacagggtcttgctctgtcacctgggctggagtgcagtagcatgatcatagctcactgtagcctttaattcctgggctcaagtgatcctctcgcctcagcctcctgagtagctaggactacaggcgcatgccaccacacccagctaatttataaattttttgtagagacagggtctcactatgttgcctaggctggtttctaactcctgggtcaactgatcctccctcctcaacctcccaaagtgctggaattataggtgtgagccaccacgcccggccagccacatggtgttaaattcaagagatacaaagaggtgtaagctgaaaggtcccccactctattcccagccacacaattctctccccataggcaaccagtgttctcagtctctactttagagacatcctataaggggagtcatacagttttgccctaatgtctggtttatttcactcagcataaccctcaaggtccatgcatggtgtggcccatgtcttcagtctttcttctcactcctggtcttccataccacactttccccacctccacttgggcctagcattccctgcatgaagcttctccattgtttcttccagcatttgcctgggcactggtactatgggctccaggtactgtcctgccctcggcgctggcctccctccctcatggtatatgctgaccacacagtgtgtgccttcctgggctgagttgggatgggccgccttgcccgttgtcagtgcccctctctgcaggcacgttggttgcactttcttcctcttggctcagaccacttcttcctctggctgccagatgtctcttagcatcatcagagatggagtttaagtttctatttcttgttctcttttttgttttgggatgaattacagaaaaaagaaaatagtgaggaggaggcaaaagatctttacttcattatcttaaaaccaaaactatgattatatttctctatcaattttatacagaaaaaaagaggggtctgactgggcatggtagctcatgcctgtaatcccagcactttgggaggccgaggcaggtggattgcttgaggccaggaatttgagaccagcctgggcaacatagcaaaaccctgcctctacaaaataatttaaaaattaccagagtatggtggtacgcacctgtagtctcagcaactcaggaggctaaggtgggaggatcaccgagcccagggagtttgaggctgcagtgagccatgattgcgccatgtactccagcctgggcaacagagtgagaccctgtctcaaaaaaaaggtgggggtgtcttgttggggtcctggttggggtcttgttttgctttgtttatataaagcaaaaggtttgaaagtgaaaaaattttctgaagcatcatgacttttctggctgtttctgaccagatatatctaacatcttaatgccagctgaattagaatcaagaaatttgtcctgctgcaaacaaacactcaccttggtcacaagcaaagctcagaaaataataatagtaataataatttgcccttttggaaggagtatgattgggtgggagactgtactcccagggtatctagctcttcctgatacacatacacacaaagggccctgtgtgactgaagactgtcatagtttgtggtacagctgtgctcctccctgtcactagctatctgttccttttctctactgtaccacatttttctccttcttctgcttctttaccaacttgtagtctctgctgatttctacccactccagatgccaccttctgctccccaccacctccttctggtgagggcattgtcctgactgggctgtgtgccatttgaggatgatgctctgtcttaactatctctgcatgtctcagagctcagtgctagttcatgacccatagtgagcactcagtgtttgttgaaaggaggaaggatggaaagtgaaactgtgtgccttctaagcagatcaccagctaatgggtgtttactttctttaacttagcgacaggccaacaccaactatcacatgtaatcttagggtctggttgaggtccctctcctcttcttatttctttctttcacaagacttgtcatttaatagcggattttatttattgctttccttgtacataaaaagataggcttcagattcccttcttccaattcttcttatcaagtcgaattccccaaacagggtggagcatgtccagcctttaccagcatcatcgagagtccttcagagctaggagaacatactggaaccaggaaaaaaaaatctgctgtggggctagggtgacctagaaagctttatcttccactgtggctgcattctgaccttttatgcaaatgagggatctccaggaaggaagtgaaagagatattccaaactgagtgtgcaggtccaattgctatttatatcatactggatgttagtcctcccaccacgatcccagaatttcacccaagaaagcagaagtatacacaaatctttcttctgaaatttatccaagttataagagccagagcaatgctgaggccatatcattttgtggagactaaaactcccaaataaagaggatgatacaaatctgtctttcgctttaagcaatgaaaatcaaatgaagtattttagttagaaaattctagtcacacaaatatttgaagatagtgtttcagaattagactcaggaaaatggatttgctgtataaattctcaagagatctgaatcattataaagtttgcttagatctttcaatttcaaaaacaagggctcttccacgacagaaatgatcatgtcttctttcagcggtttaaattcaggaaaggtcactgtgtccttagatgaaaaaaggtaagttaaaggcagaggatctcaaagtttattggccataagccattgtgggaaatacatagaaacctactctgtacataaagcaaacgtttcataaaaccatattgacctttcctatgtgcagtgctttctgaccttttctgttttattctgttataattcattttaaaaaatactggtaattggctggatgcagtggctcccgcttttaatccagcactttgggaggccgagacaggcagacgacttcaggtcaggagtttgagaccagcctggccaacatggtgaaaccccgtctctactaaaaatacaaaaattagccgggcatggtagtgggcacctgtaatcccagctacttgggaggctgaggcaggagaatcgcttgaacctgggaggcggaggttgcagtgagccaagatcgctccactgcactccagcctaggtgaaagagggagactctgcctcaaaaaaaaaataaaataaaataaaataaaataaaatactggtagtactctaaaaaagtcaatttgttgatcccaaattgttgatcccaaatgcggatagtgccccgcaatttgaaaaacactgattagaaaatacattcaaaagaaggttctgtttcaaatctggtaaaaagccatttcccctgaagctgccacttatttagaatccttccagtgaccagtgatggtataatctacagctttgaaaaagagatagctatggaaaggaaattcgttgtgaggaatggagcccctctcatatgccagatattgtatatactttgcatgacatacattcttctctagagaagttcacatcctacagaacagggtatccatgaaatatgcaaaacatacaggtgtggatagatactgctagatgagcacataattgaaggattaatctcctttatcatgcaggaaaatgttattattataatgatcttttttaccctttaaagctattctcaggatcaaagattgacagttcagcttctgaattaccctgagacatttgaccacattaaaaacattctctattaccaggccttttgcagagctctagaggagtaatgagcaccttacttctctcctggaggtcaggaatatgcaaatccagagtcagagtgagctgtcactctggccaggtactgcagattggaacagttaactgcgtctgtgaagtagctccacttgagactatgattggggttcagttttcctcctcaattaatatcttgctcttaaaagacagtgacatccacaagatatgtagcacaaactacagacaagtgtccttcagattaactgaaccatcattattttccaaattaatccctaagtttttaactatttggcaagcatgtaaccaatttgttgggctgacttaagggtgctgactttaagtaaatgaaaataccaattattaaatgaaaagccaatttttgaaaaatgtccgtataagataatatgtggtaaaattatttttttcataaatatactacaagttgaagctgaaagcatgctaccctgcaaacataattaaagttgagagttaggattagatttgggtgatttatttgaaatgtgaggcaagtccaatatccttttgttattaaagagaacttggctgtggctcctacttaacaaattttggcaaactgaatgctgtcttgatcccctccatgctaaatttatttattgagttgcttgcagaaatttccttagcttctatattagttggcaagggctgccataacaatacaacacactgggtaatttaaacaacagacgtttatttttccggggttctggagtttcaaagtccaaggtcaaggtgctagccaggttgatttctcctgaggcctctctcctggacttgtagatggctgcctcctccctgtgtcttcacatggtctttcccctatactagtctgtgttctaatctcctcttataaggatactagtcatattggattaagacctacccaaatggcctcattttaacttagttacctctataaaggccttatctctaaatatggtgctgtcaattctgaggtgtacgcggggttaggacttcaacctaggaattttgggaggatgctgttcaacccctaacagcctcagtaaagcttgtttcaatcatggttacaggatgtgaggagcaaaaagaccactgcagtgcttgaccctctgccaggtttctaaacggcatgggtttctgttctttttgtttttttccaccctagggagaactaatgccgacgtgatgaccgccctgtcccagggctacaggatgccccgtgtggagaactgcccagatgagctctatgacattatgaaaatgtgctggaaagaaaaggcagaagagagaccaacgtttgactacttacagagcgtcctggatgatttctacacagccacggaagggcaataccagcagcagccttagagcacagggagacccgtccatttggcaggggtggctgcctcatttagagaggaaaagtaaccatcactggttgcacttatgatttcatgtgcggggatcatctgccgtgcctggatcctgaaatagaggctaaattactcaggaagaacaccctctaaatgggaaagtattctgtactcttagatggattctccactcagttgcaacttggacttgtcctcagcagctggtaatcttgctctgcttgacaacatctgagtgcagccgtttgagaagaaaacatctattctctccaaaaatgcacccaactagctctatgtttacaaatggacataggactcaaagtttcagagaccattgcaatgaatccccaataattgcagaactaaactcatttataaagctaaaataaccggatatatacatagcatgacatttctttgtgctttggcttacttgtttaaaaaaaaaaaaaaactaatccaacctgttagattttgcaggtgaagtcagcagcttaaaaatgtctttcccagatttcaatgatttttttccccctacctcccaaaatctgagactgttaaaacatttttcttctatgaacactgctcagacctgctagacatgccataggagtggcgtgcacatctctctctcttccagcaggaggagcccgtgagcacgcacagctgccctgtctgctcacccgaaggcaccgggctcacctggacctcccaggaaagggagaagagcctcagaaactgctctgtgtttagaaggaatatttttaagagtccagctttttcatttccacaatttcctatatccagatttgttttgacaatgtagtttggaagaactaagattctaatctctgaagaaccttatagggccttctaaaacataagagtttcctttgttgcttcaaatatttgaacattatgttaaagatcaagtattaattttagttgtactctagaaagctaaagtgccacattcggggctatttttatgattcagcaatcttttctaaattgtgtagcatgtgtatgagactatttatacccaaggatatgaaggaacataagtgactacaaggctctaataagccacggtggcaggaggttcaagcggttctgttcactaaatttttctcctgtaagctttgaatggaaacttctgtatcacatgatgtgtttcacttatgctgttgtgtatatacctaatatttctatttttgattttattttaatacacctcgtccaataaca

SEQ ID NO: 35 - DNA, 7759 bp, homo sapiens
aaaaagtgctttattttcccactccccggacgcccagcagggcagtttcttgaccttcggagcccctttcccgaggatccgctcgggagcctcccctggccaggagcaggggattagtctgccccgcgaccggccccagccacgacgcggacatcgccccctctgtctgggccgctgtcactcacgcgccaaagggccacggagaaagaaggggcgggccggggcgggccgggcgagcggaggcggggacttgcgccgtcctgaggctgcctcctagggtccggccggcgctggagctgcggatttagattgtcactgccacctcggtcggtgcttacttcgctgccagctggtcgtcgccatgaacccggacctgcgcagggagcgggattccgccagcttcaacccggagctgcttacacacatcctggacggcagccccgagaaaacccggcgccgccgagagatcggtgagggcggcgggcgagacctccctcctttcccgagaaaagctggagactccctcgatgcggagtcaggggcgctgtggggcctaggccctctggcccagcgttaggggagccgggacccccacttcgaggaacagcctgtgtccctggtggggggatatcgccattccccagagaacatgatcctgaacgacccagacttccagcatgaggacttgaacttcctcactcgcagccagcgttatgaggtggctgtcaggaaaagtgccatcatggtgaagaagatgagggagtttggcatcgctgaccctgatgaaattatgtggtttaaaaattttgtgcaccgagggcggcctgagcctctggatcttcacttgggcatgttcctgcccaccttgcttcaccaggcaactgcggagcagcaggagcgcttcttcatgcccgcctggaacttggagatcattggcacttatgcccagacagagatgggtcatggaactcaccttcgaggcttggaaaccacagccacgtatgaccctgaaacccaggagttcattctcaacagtcctactgtgacctccattaaatggtggcctggtgggcttggaaagacttcaaatcatgcaatagttcttgcccagctcatcactaaggggaaatgctatggattacatgcctttatcgtacctattcgtgaaatcgggacccataagcctttgccaggaattaccgttggtgacatcggccccaaatttggttatgatgagatagacaatggctacctcaaaatggacaaccatcgtattcccagagaaaacatgctgatgaagtatgcccaggtgaagcctgatggcacatacgtgaaaccgctgagtaacaagctgacttacgggaccatggtgtttgtcaggtccttccttgtgggagaagctgctcgggctctgtctaaggcgtgcaccattgccatccgatacagcgctgtgaggcaccagtctgaaatcaagccaggtgaaccagaaccacagattttggattttcaaacccagcagtataaactctttccactcctggccactgcctatgccttccagtttgtgggcgcatacatgaaggagacctatcaccggattaacgaaggcattggtcaaggggacctgagtgaactgcctgagcttcatgccctcaccgctggactgaaggctttcacctcctggactgcaaacactggcattgaagcatgtcggatggcttgtggtgggcatggctattctcattgcagtggtcttccaaatatttatgtcaatttcaccccaagctgtacctttgagggagaaaacactgtcatgatgctccagacggctaggttcctgatgaaaagttatgatcaggtgcactcaggaaagttggtgtgtggcatggtgtcctatttgaacgacctgcccagtcagcgcatccagccacagcaggtagcagtctggccaaccatggtggatatcaacagccccgaaagcctaaccgaagcatataaactccgtgcagccagattagtagaaattgctgcaaaaaaccttcaaaaagaagtgattcacagaaaaagcaaggaggtagcttggaacctaacttctgttgaccttgttcgagcaagtgaggcacattgccactatgtggtagttaagctcttttcagaaaaactcctcaaaattcaagataaagccattcaagctgtcttaaggagtttatgtctgctgtattctctgtatggaatcagtcagaacgcgggggatttccttcaggggagcatcatgacagagcctcagattacacaagtaaaccagcgtgtaaaggagttactcactctgattcgctcagatgctgttgctttggttgatgcatttgattttcaggatgtgacacttggctctgtgcttggccgctatgatgggaatgtgtatgaaaacttgtttgagtgggctaagaactccccactgaacaaagcagaggtccacgaatcttacaagcacctgaagtcactgcagtccaagctctgaagtgtcacaaggacaagtttaatctgcttcagaaagcgcctgtgtgcaactcaaattttgtggaatctttttcgaattcaaatagctatagagcaaatgataaattgacccctttttataaatggagggaaaaaatgaacagatttcagagattaaatgaaaaaaagcagatgttttaagtgcaattaacactgaaagagacctgttaaaccattcagaaaaagcttaagaaatgcgatatgacttccttttgtaatgctgctgatcccagtagactatgacttttgataattagcagaatttaactactgagtagttgattattttcacattttaattgctaatcactggctatataagtgtttttaagcaaaggtatttttgaagtggtgtagaacccttccaagctttcctgctcagtgttctaccagacttaccctggggcctggcttaaaagcaggattgaagaaaagggactgggggaaggaaacttattggaaaacttgatgcgaatgagtttctgcttggcacagtctctgcctgcttgctctcctttgctgatggattgcatttatcaaactattcatgctagcatttttccaacgagggaacttattccgcacgggcctactgtaggaccattgtctcgtgtaattaggaattttccatttgaaggattgctaaattgtcacagtagtaggaagtatagggaaacctctcagctgtggcactgttgtagctttggagtgcagagtgtaactctgggacaatcagatttcacatattctgtcatcttggcataagccattaaaagcttggagattactgtatttggcattaaaaaaaaatgtcacttaggtcagcactcccagacgtagcacagaaaaaccctttgacacaaaccatgtgttctgatttttggttcagaaaatattgaaactgtgagttgttttttttttaacaactgggaaaaaacaaaaacaaaaaactatagttagaaaaatggaagttccataggttctatttcttactctatgtatggctttgttttcagtctatttctaggagctttctctgaatcgctaattgtcctttcagttgaaatctaatttatacaatcattctatacttaaaggttaaatacatcttaattaattttttcttaaagtcaatgtaagtcactttgttttgtttttttttaatctacgccatatgcctcatgaaaccagctgttctagaatcagtcctgagaatatggcttaattccatggaaacataactcctatcttgggacctgacataatatctatctatcctggggaactggtaatatgagacttataggttacagcagaaatgctacatgttgacaaaagccttaatcgttccactgggagaactaattgataattgtgttaagattgaagattaaccctgtgttaatctcacttgagtctatcctgacagtagttcagattctggaaaatgataaactgacctgctagatgtagaattgtttcaaaattagtgttgaaataccttgttcacagatgaatatctgggcaggatctgagggtgtttggaatgacaccccccaatccagttgcatagatgggatgtctttgcaggtttgaggagatcatcgacctgcagagccccctttgacccagtacctcacgttttatttaaaatctaaatctggggccaggcgtggtggctcacgcctgtaatccaagcactttgggaggccgaagcgggtggatcacctgaggtcaggagtttgagaccatcctggccaacatggtgaaaccccgtctctactgaaaaaaatacaaaaattagctgggcatggtggtagcacgcgcctgtagtcccagctactcgggaggctgaggcaggataatcgcttgaacttggcgggtagaggttgcagtgagccaagatggtgccactacactgcagcctgggtggctgagcgagactccgtctcaaaaaaaaaatctaaatctgacatttgatgctatttttattaatattggaatgttctgtcttgaactttattcaatataatcaagaataaagatagagtaaacgtcactgatttgtactattaagagagaaaaaatatgccacacaactaaacataggtttaaattatgaagaaatttagaatagaggtttattagatttagggaacactaagaacaaaaaaggaaggagtgatacctgcctgagtggacagctgtaaatcagctgtaattactgcagttgtaccaatagttgtgagtggctccagtcactttaggagtccttggaagtacttggtacacatttgttggctgtaccttaaaggaagtggcaagtccagtttgttctctctaccacactagactgccactgacaagtttgggtctgttggattcaaaattttgtaagccattttcacaagtacaaagatacattttaaccttgtcttctccaaaattactgagtaggaattttatttttatctttttgagacagggtatcactgtcacccagactggagtgcagtggtgggatcttggcttactgtgacctctgcctcccgggttcaaatggtcctccctcctcagtctcctgagtagctgggacgacaggcacgtgccaccatgcccagctaatttgttctattttttctgtagagacggggttttgccatgttgcccaggctggtctcagactcctgggctcaagcgatcatttcgcctcagcctcccaaagtgctgagattataggtgtgagccacagcatctggcccagagtgaggagaattaatgagattttttgtgtgtgttagataatattgatttaagcctttttttaaaaagtactctcaaccaaatacaaaattgaaaatgtgaggtttaatagaaatgtgttggctatttgcaatggattttcttcttgcccaagtgtttggagttctactttatgctctgtatttaaaaattagtgacctcaaagcagagttgatgacacaggctttggggccctcatgttcttgtctttagaacatatcactactaagtatcagcttatcttcagaacattacaacattcaccgtgttcatatgctttctgagaagtcaccacttgtaatttcagatcacatacacctgaaggcattttatagttcctaaagttaacatgttagatcttttttttccaccccatgagggtctcactctcacccaggctggaatgcagtggtgtgattgtagcacactttggccaccaactcctgggctcaagtgatcctcctgctttggcctcctctgagaagctgggattactggtgcacaccaccacacctggctaattttttatttttttttatttttggaaatagggtatggctatgttgccttgggcccgtcatgaactcctagcctcaggtgaccctcccacctcaggcctcccaaagggttgggattacaggagtgagctactgcactgggccaacatgttaatttttttttttttttttttgagatggagtctcccaggcgggaatgcaatggtgcgatctcgacttcactgcaatcttcacctcccgggttcgagcgattctcccacctcagcctcctgagtagctgggattacaggcacctgccatcacgctcggctaatttttgtattttgagcagagatggagtttcaccatgttggccaggtgatctgcactcccactccccccacacttcccaaagtgctgggattacaggcataagccacaagccacctcacccagccaacatgttacatcttaattcttggattttcttcactgcagggctttgggtggagaaataaaactcttcaaatgcatgatcttggagatccctgtgaatcaataattctttagacaactgcggctcaaaatccctcctttcccttttccgagttattccatccatcttattagaaaggaagtgaattaggtgtaggtggtctgtaacacctgcacatctttttatacgtgtagagggtatgcctgggatatataggttgtcttcaagcagtagctgctactacagctagagagaggaggagtgccaggaaactgatgacctgagaccaagagtcttgttgatgttctgacttagataaaggttttgatcattttcatgaaataatgcagggaagtcatttctgctgtttctttactactccattcttggaggattagaacaagtcacactgtaattgactaaaacgactttttattttaaaatattgatggtggggttttgcttttttttttttttttttttttgagacgttgtcttgctctttcacccagggtagagtgcagtggcgaaatcttggctcactgcaacctctgcctcccgggttcaagcaattctctgcctcagcctcctgagaagctgggattacagcgcctgccaccatgcctgtctagtttttttgtatttttagtagagacaggggtttcaccaagttggccaggctggtcttgaactcctgacctcgtgatccacccacctcggcctcccaaagtgctgggattacaggcgtgagccaccgtgccgggccagtgtttttaactgtccacacttactaaattttccagtacttcttcctatggttcatgatagtaaacacagaaacatataaggaacattattagagttaccagatgttagctgttgcatatgtgcacattcctagattcaagggtgtttttgccttaaatttaagtgggtcattggttgtcttgggaagatcatggaaaattcgggattttttagaattctgaaccaaaatatgttttgagtgtttcttagtaaatgtgtgatcttccaccttccacattcagactgcggactacacttcataaatgcctttttatttccagttatggattcaactaaatgactgccttgggagcacataattactttgctacctttttccccctttgctgttgtggctcgagtttggttctcacctgagaagatgcattgagcatatgttgttacccagccctggcttaatggtgtcctgtggggtaggggtgggaggacgaggggcacggggccagagcatgtgaatggatcatggttggacagctgtgacctgccagcactgcgggtaagcaaaactacaaaccgttctttcctctgtgacattgaataaaccttaataaaattcataattagcacatactagaaaaaa

SEQ ID NO: 36 - DNA, 7585 bp, homo sapiens
aaaaagtgctttattttcccactccccggacgcccagcagggcagtttcttgaccttcggagcccctttcccgaggatccgctcgggagcctcccctggccaggagcaggggattagtctgccccgcgaccggccccagccacgacgcggacatcgccccctctgtctgggccgctgtcactcacgcgccaaagggccacggagaaagaaggggcgggccggggcgggccgggcgagcggaggcggggacttgcgccgtcctgaggctgcctcctagggtccggccggcgctggagctgcggatttagattgtcactgccacctcggtcggtgcttacttcgctgccagctggtcgtcgccatgaacccggacctgcgcagggagcgggattccgccagcttcaacccggagctgcttacacacatcctggacggcagccccgagaaaacccggcgccgccgagagatcgagaacatgatcctgaacgacccagacttccagcatgaggacttgaacttcctcactcgcagccagcgttatgaggtggctgtcaggaaaagtgccatcatggtgaagaagatgagggagtttggcatcgctgaccctgatgaaattatgtggtttaaaaattttgtgcaccgagggcggcctgagcctctggatcttcacttgggcatgttcctgcccaccttgcttcaccaggcaactgcggagcagcaggagcgcttcttcatgcccgcctggaacttggagatcattggcacttatgcccagacagagatgggtcatggaactcaccttcgaggcttggaaaccacagccacgtatgaccctgaaacccaggagttcattctcaacagtcctactgtgacctccattaaatggtggcctggtgggcttggaaagacttcaaatcatgcaatagttcttgcccagctcatcactaaggggaaatgctatggattacatgcctttatcgtacctattcgtgaaatcgggacccataagcctttgccaggaattaccgttggtgacatcggccccaaatttggttatgatgagatagacaatggctacctcaaaatggacaaccatcgtattcccagagaaaacatgctgatgaagtatgcccaggtgaagcctgatggcacatacgtgaaaccgctgagtaacaagctgacttacgggaccatggtgtttgtcaggtccttccttgtgggagaagctgctcgggctctgtctaaggcgtgcaccattgccatccgatacagcgctgtgaggcaccagtctgaaatcaagccaggtgaaccagaaccacagattttggattttcaaacccagcagtataaactctttccactcctggccactgcctatgccttccagtttgtgggcgcatacatgaaggagacctatcaccggattaacgaaggcattggtcaaggggacctgagtgaactgcctgagcttcatgccctcaccgctggactgaaggctttcacctcctggactgcaaacactggcattgaagcatgtcggatggcttgtggtgggcatggctattctcattgcagtggtcttccaaatatttatgtcaatttcaccccaagctgtacctttgagggagaaaacactgtcatgatgctccagacggctaggttcctgatgaaaagttatgatcaggtgcactcaggaaagttggtgtgtggcatggtgtcctatttgaacgacctgcccagtcagcgcatccagccacagcaggtagcagtctggccaaccatggtggatatcaacagccccgaaagcctaaccgaagcatataaactccgtgcagccagattagtagaaattgctgcaaaaaaccttcaaaaagaagtgattcacagaaaaagcaaggaggtagcttggaacctaacttctgttgaccttgttcgagcaagtgaggcacattgccactatgtggtagttaagctcttttcagaaaaactcctcaaaattcaagataaagccattcaagctgtcttaaggagtttatgtctgctgtattctctgtatggaatcagtcagaacgcgggggatttccttcaggggagcatcatgacagagcctcagattacacaagtaaaccagcgtgtaaaggagttactcactctgattcgctcagatgctgttgctttggttgatgcatttgattttcaggatgtgacacttggctctgtgcttggccgctatgatgggaatgtgtatgaaaacttgtttgagtgggctaagaactccccactgaacaaagcagaggtccacgaatcttacaagcacctgaagtcactgcagtccaagctctgaagtgtcacaaggacaagtttaatctgcttcagaaagcgcctgtgtgcaactcaaattttgtggaatctttttcgaattcaaatagctatagagcaaatgataaattgacccctttttataaatggagggaaaaaatgaacagatttcagagattaaatgaaaaaaagcagatgttttaagtgcaattaacactgaaagagacctgttaaaccattcagaaaaagcttaagaaatgcgatatgacttccttttgtaatgctgctgatcccagtagactatgacttttgataattagcagaatttaactactgagtagttgattattttcacattttaattgctaatcactggctatataagtgtttttaagcaaaggtatttttgaagtggtgtagaacccttccaagctttcctgctcagtgttctaccagacttaccctggggcctggcttaaaagcaggattgaagaaaagggactgggggaaggaaacttattggaaaacttgatgcgaatgagtttctgcttggcacagtctctgcctgcttgctctcctttgctgatggattgcatttatcaaactattcatgctagcatttttccaacgagggaacttattccgcacgggcctactgtaggaccattgtctcgtgtaattaggaattttccatttgaaggattgctaaattgtcacagtagtaggaagtatagggaaacctctcagctgtggcactgttgtagctttggagtgcagagtgtaactctgggacaatcagatttcacatattctgtcatcttggcataagccattaaaagcttggagattactgtatttggcattaaaaaaaaatgtcacttaggtcagcactcccagacgtagcacagaaaaaccctttgacacaaaccatgtgttctgatttttggttcagaaaatattgaaactgtgagttgttttttttttaacaactgggaaaaaacaaaaacaaaaaactatagttagaaaaatggaagttccataggttctatttcttactctatgtatggctttgttttcagtctatttctaggagctttctctgaatcgctaattgtcctttcagttgaaatctaatttatacaatcattctatacttaaaggttaaatacatcttaattaattttttcttaaagtcaatgtaagtcactttgttttgtttttttttaatctacgccatatgcctcatgaaaccagctgttctagaatcagtcctgagaatatggcttaattccatggaaacataactcctatcttgggacctgacataatatctatctatcctggggaactggtaatatgagacttataggttacagcagaaatgctacatgttgacaaaagccttaatcgttccactgggagaactaattgataattgtgttaagattgaagattaaccctgtgttaatctcacttgagtctatcctgacagtagttcagattctggaaaatgataaactgacctgctagatgtagaattgtttcaaaattagtgttgaaataccttgttcacagatgaatatctgggcaggatctgagggtgtttggaatgacaccccccaatccagttgcatagatgggatgtctttgcaggtttgaggagatcatcgacctgcagagccccctttgacccagtacctcacgttttatttaaaatctaaatctggggccaggcgtggtggctcacgcctgtaatccaagcactttgggaggccgaagcgggtggatcacctgaggtcaggagtttgagaccatcctggccaacatggtgaaaccccgtctctactgaaaaaaatacaaaaattagctgggcatggtggtagcacgcgcctgtagtcccagctactcgggaggctgaggcaggataatcgcttgaacttggcgggtagaggttgcagtgagccaagatggtgccactacactgcagcctgggtggctgagcgagactccgtctcaaaaaaaaaatctaaatctgacatttgatgctatttttattaatattggaatgttctgtcttgaactttattcaatataatcaagaataaagatagagtaaacgtcactgatttgtactattaagagagaaaaaatatgccacacaactaaacataggtttaaattatgaagaaatttagaatagaggtttattagatttagggaacactaagaacaaaaaaggaaggagtgatacctgcctgagtggacagctgtaaatcagctgtaattactgcagttgtaccaatagttgtgagtggctccagtcactttaggagtccttggaagtacttggtacacatttgttggctgtaccttaaaggaagtggcaagtccagtttgttctctctaccacactagactgccactgacaagtttgggtctgttggattcaaaattttgtaagccattttcacaagtacaaagatacattttaaccttgtcttctccaaaattactgagtaggaattttatttttatctttttgagacagggtatcactgtcacccagactggagtgcagtggtgggatcttggcttactgtgacctctgcctcccgggttcaaatggtcctccctcctcagtctcctgagtagctgggacgacaggcacgtgccaccatgcccagctaatttgttctattttttctgtagagacggggttttgccatgttgcccaggctggtctcagactcctgggctcaagcgatcatttcgcctcagcctcccaaagtgctgagattataggtgtgagccacagcatctggcccagagtgaggagaattaatgagattttttgtgtgtgttagataatattgatttaagcctttttttaaaaagtactctcaaccaaatacaaaattgaaaatgtgaggtttaatagaaatgtgttggctatttgcaatggattttcttcttgcccaagtgtttggagttctactttatgctctgtatttaaaaattagtgacctcaaagcagagttgatgacacaggctttggggccctcatgttcttgtctttagaacatatcactactaagtatcagcttatcttcagaacattacaacattcaccgtgttcatatgctttctgagaagtcaccacttgtaatttcagatcacatacacctgaaggcattttatagttcctaaagttaacatgttagatcttttttttccaccccatgagggtctcactctcacccaggctggaatgcagtggtgtgattgtagcacactttggccaccaactcctgggctcaagtgatcctcctgctttggcctcctctgagaagctgggattactggtgcacaccaccacacctggctaattttttatttttttttatttttggaaatagggtatggctatgttgccttgggcccgtcatgaactcctagcctcaggtgaccctcccacctcaggcctcccaaagggttgggattacaggagtgagctactgcactgggccaacatgttaatttttttttttttttttttgagatggagtctcccaggcgggaatgcaatggtgcgatctcgacttcactgcaatcttcacctcccgggttcgagcgattctcccacctcagcctcctgagtagctgggattacaggcacctgccatcacgctcggctaatttttgtattttgagcagagatggagtttcaccatgttggccaggtgatctgcactcccactccccccacacttcccaaagtgctgggattacaggcataagccacaagccacctcacccagccaacatgttacatcttaattcttggattttcttcactgcagggctttgggtggagaaataaaactcttcaaatgcatgatcttggagatccctgtgaatcaataattctttagacaactgcggctcaaaatccctcctttcccttttccgagttattccatccatcttattagaaaggaagtgaattaggtgtaggtggtctgtaacacctgcacatctttttatacgtgtagagggtatgcctgggatatataggttgtcttcaagcagtagctgctactacagctagagagaggaggagtgccaggaaactgatgacctgagaccaagagtcttgttgatgttctgacttagataaaggttttgatcattttcatgaaataatgcagggaagtcatttctgctgtttctttactactccattcttggaggattagaacaagtcacactgtaattgactaaaacgactttttattttaaaatattgatggtggggttttgcttttttttttttttttttttttgagacgttgtcttgctctttcacccagggtagagtgcagtggcgaaatcttggctcactgcaacctctgcctcccgggttcaagcaattctctgcctcagcctcctgagaagctgggattacagcgcctgccaccatgcctgtctagtttttttgtatttttagtagagacaggggtttcaccaagttggccaggctggtcttgaactcctgacctcgtgatccacccacctcggcctcccaaagtgctgggattacaggcgtgagccaccgtgccgggccagtgtttttaactgtccacacttactaaattttccagtacttcttcctatggttcatgatagtaaacacagaaacatataaggaacattattagagttaccagatgttagctgttgcatatgtgcacattcctagattcaagggtgtttttgccttaaatttaagtgggtcattggttgtcttgggaagatcatggaaaattcgggattttttagaattctgaaccaaaatatgttttgagtgtttcttagtaaatgtgtgatcttccaccttccacattcagactgcggactacacttcataaatgcctttttatttccagttatggattcaactaaatgactgccttgggagcacataattactttgctacctttttccccctttgctgttgtggctcgagtttggttctcacctgagaagatgcattgagcatatgttgttacccagccctggcttaatggtgtcctgtggggtaggggtgggaggacgaggggcacggggccagagcatgtgaatggatcatggttggacagctgtgacctgccagcactgcgggtaagcaaaactacaaaccgttctttcctctgtgacattgaataaaccttaataaaattcataattagcacatactagaaaaaa

SEQ ID NO: 37 - DNA, 7585 bp, homo sapiens
aaaaagtgctttattttcccactccccggacgcccagcagggcagtttcttgaccttcggagcccctttcccgaggatccgctcgggagcctcccctggccaggagcaggggattagtctgccccgcgaccggccccagccacgacgcggacatcgccccctctgtctgggccgctgtcactcacgcgccaaagggccacggagaaagaaggggcgggccggggcgggccgggcgagcggaggcggggacttgcgccgtcctgaggctgcctcctagggtccggccggcgctggagctgcggatttagattgtcactgccacctcggtcggtgcttacttcgctgccagctggtcgtcgccatgaacccggacctgcgcagggagcgggattccgccagcttcaacccggagctgcttacacacatcctggacggcagccccgagaaaacccggcgccgccgagagatcgagaacatgatcctgaacgacccagacttccagcatgaggacttgaacttcctcactcgcagccagcgttatgaggtggctgtcaggaaaagtgccatcatggtgaagaagatgagggagtttggcatcgctgaccctgatgaaattatgtggtttaaaaaactacatttggtcaattttgtggaacctgtgggcctcaattactccatgtttattcctaccttgctgaatcagggcaccactgctcagaaagagaaatggctgctttcatccaaaggactccagataattggcacctacgcccagacggaaatgggccacggaactcaccttcgaggcttggaaaccacagccacgtatgaccctgaaacccaggagttcattctcaacagtcctactgtgacctccattaaatggtggcctggtgggcttggaaagacttcaaatcatgcaatagttcttgcccagctcatcactaaggggaaatgctatggattacatgcctttatcgtacctattcgtgaaatcgggacccataagcctttgccaggaattaccgttggtgacatcggccccaaatttggttatgatgagatagacaatggctacctcaaaatggacaaccatcgtattcccagagaaaacatgctgatgaagtatgcccaggtgaagcctgatggcacatacgtgaaaccgctgagtaacaagctgacttacgggaccatggtgtttgtcaggtccttccttgtgggagaagctgctcgggctctgtctaaggcgtgcaccattgccatccgatacagcgctgtgaggcaccagtctgaaatcaagccaggtgaaccagaaccacagattttggattttcaaacccagcagtataaactctttccactcctggccactgcctatgccttccagtttgtgggcgcatacatgaaggagacctatcaccggattaacgaaggcattggtcaaggggacctgagtgaactgcctgagcttcatgccctcaccgctggactgaaggctttcacctcctggactgcaaacactggcattgaagcatgtcggatggcttgtggtgggcatggctattctcattgcagtggtcttccaaatatttatgtcaatttcaccccaagctgtacctttgagggagaaaacactgtcatgatgctccagacggctaggttcctgatgaaaagttatgatcaggtgcactcaggaaagttggtgtgtggcatggtgtcctatttgaacgacctgcccagtcagcgcatccagccacagcaggtagcagtctggccaaccatggtggatatcaacagccccgaaagcctaaccgaagcatataaactccgtgcagccagattagtagaaattgctgcaaaaaaccttcaaaaagaagtgattcacagaaaaagcaaggaggtagcttggaacctaacttctgttgaccttgttcgagcaagtgaggcacattgccactatgtggtagttaagctcttttcagaaaaactcctcaaaattcaagataaagccattcaagctgtcttaaggagtttatgtctgctgtattctctgtatggaatcagtcagaacgcgggggatttccttcaggggagcatcatgacagagcctcagattacacaagtaaaccagcgtgtaaaggagttactcactctgattcgctcagatgctgttgctttggttgatgcatttgattttcaggatgtgacacttggctctgtgcttggccgctatgatgggaatgtgtatgaaaacttgtttgagtgggctaagaactccccactgaacaaagcagaggtccacgaatcttacaagcacctgaagtcactgcagtccaagctctgaagtgtcacaaggacaagtttaatctgcttcagaaagcgcctgtgtgcaactcaaattttgtggaatctttttcgaattcaaatagctatagagcaaatgataaattgacccctttttataaatggagggaaaaaatgaacagatttcagagattaaatgaaaaaaagcagatgttttaagtgcaattaacactgaaagagacctgttaaaccattcagaaaaagcttaagaaatgcgatatgacttccttttgtaatgctgctgatcccagtagactatgacttttgataattagcagaatttaactactgagtagttgattattttcacattttaattgctaatcactggctatataagtgtttttaagcaaaggtatttttgaagtggtgtagaacccttccaagctttcctgctcagtgttctaccagacttaccctggggcctggcttaaaagcaggattgaagaaaagggactgggggaaggaaacttattggaaaacttgatgcgaatgagtttctgcttggcacagtctctgcctgcttgctctcctttgctgatggattgcatttatcaaactattcatgctagcatttttccaacgagggaacttattccgcacgggcctactgtaggaccattgtctcgtgtaattaggaattttccatttgaaggattgctaaattgtcacagtagtaggaagtatagggaaacctctcagctgtggcactgttgtagctttggagtgcagagtgtaactctgggacaatcagatttcacatattctgtcatcttggcataagccattaaaagcttggagattactgtatttggcattaaaaaaaaatgtcacttaggtcagcactcccagacgtagcacagaaaaaccctttgacacaaaccatgtgttctgatttttggttcagaaaatattgaaactgtgagttgttttttttttaacaactgggaaaaaacaaaaacaaaaaactatagttagaaaaatggaagttccataggttctatttcttactctatgtatggctttgttttcagtctatttctaggagctttctctgaatcgctaattgtcctttcagttgaaatctaatttatacaatcattctatacttaaaggttaaatacatcttaattaattttttcttaaagtcaatgtaagtcactttgttttgtttttttttaatctacgccatatgcctcatgaaaccagctgttctagaatcagtcctgagaatatggcttaattccatggaaacataactcctatcttgggacctgacataatatctatctatcctggggaactggtaatatgagacttataggttacagcagaaatgctacatgttgacaaaagccttaatcgttccactgggagaactaattgataattgtgttaagattgaagattaaccctgtgttaatctcacttgagtctatcctgacagtagttcagattctggaaaatgataaactgacctgctagatgtagaattgtttcaaaattagtgttgaaataccttgttcacagatgaatatctgggcaggatctgagggtgtttggaatgacaccccccaatccagttgcatagatgggatgtctttgcaggtttgaggagatcatcgacctgcagagccccctttgacccagtacctcacgttttatttaaaatctaaatctggggccaggcgtggtggctcacgcctgtaatccaagcactttgggaggccgaagcgggtggatcacctgaggtcaggagtttgagaccatcctggccaacatggtgaaaccccgtctctactgaaaaaaatacaaaaattagctgggcatggtggtagcacgcgcctgtagtcccagctactcgggaggctgaggcaggataatcgcttgaacttggcgggtagaggttgcagtgagccaagatggtgccactacactgcagcctgggtggctgagcgagactccgtctcaaaaaaaaaatctaaatctgacatttgatgctatttttattaatattggaatgttctgtcttgaactttattcaatataatcaagaataaagatagagtaaacgtcactgatttgtactattaagagagaaaaaatatgccacacaactaaacataggtttaaattatgaagaaatttagaatagaggtttattagatttagggaacactaagaacaaaaaaggaaggagtgatacctgcctgagtggacagctgtaaatcagctgtaattactgcagttgtaccaatagttgtgagtggctccagtcactttaggagtccttggaagtacttggtacacatttgttggctgtaccttaaaggaagtggcaagtccagtttgttctctctaccacactagactgccactgacaagtttgggtctgttggattcaaaattttgtaagccattttcacaagtacaaagatacattttaaccttgtcttctccaaaattactgagtaggaattttatttttatctttttgagacagggtatcactgtcacccagactggagtgcagtggtgggatcttggcttactgtgacctctgcctcccgggttcaaatggtcctccctcctcagtctcctgagtagctgggacgacaggcacgtgccaccatgcccagctaatttgttctattttttctgtagagacggggttttgccatgttgcccaggctggtctcagactcctgggctcaagcgatcatttcgcctcagcctcccaaagtgctgagattataggtgtgagccacagcatctggcccagagtgaggagaattaatgagattttttgtgtgtgttagataatattgatttaagcctttttttaaaaagtactctcaaccaaatacaaaattgaaaatgtgaggtttaatagaaatgtgttggctatttgcaatggattttcttcttgcccaagtgtttggagttctactttatgctctgtatttaaaaattagtgacctcaaagcagagttgatgacacaggctttggggccctcatgttcttgtctttagaacatatcactactaagtatcagcttatcttcagaacattacaacattcaccgtgttcatatgctttctgagaagtcaccacttgtaatttcagatcacatacacctgaaggcattttatagttcctaaagttaacatgttagatcttttttttccaccccatgagggtctcactctcacccaggctggaatgcagtggtgtgattgtagcacactttggccaccaactcctgggctcaagtgatcctcctgctttggcctcctctgagaagctgggattactggtgcacaccaccacacctggctaattttttatttttttttatttttggaaatagggtatggctatgttgccttgggcccgtcatgaactcctagcctcaggtgaccctcccacctcaggcctcccaaagggttgggattacaggagtgagctactgcactgggccaacatgttaatttttttttttttttttttgagatggagtctcccaggcgggaatgcaatggtgcgatctcgacttcactgcaatcttcacctcccgggttcgagcgattctcccacctcagcctcctgagtagctgggattacaggcacctgccatcacgctcggctaatttttgtattttgagcagagatggagtttcaccatgttggccaggtgatctgcactcccactccccccacacttcccaaagtgctgggattacaggcataagccacaagccacctcacccagccaacatgttacatcttaattcttggattttcttcactgcagggctttgggtggagaaataaaactcttcaaatgcatgatcttggagatccctgtgaatcaataattctttagacaactgcggctcaaaatccctcctttcccttttccgagttattccatccatcttattagaaaggaagtgaattaggtgtaggtggtctgtaacacctgcacatctttttatacgtgtagagggtatgcctgggatatataggttgtcttcaagcagtagctgctactacagctagagagaggaggagtgccaggaaactgatgacctgagaccaagagtcttgttgatgttctgacttagataaaggttttgatcattttcatgaaataatgcagggaagtcatttctgctgtttctttactactccattcttggaggattagaacaagtcacactgtaattgactaaaacgactttttattttaaaatattgatggtggggttttgcttttttttttttttttttttttgagacgttgtcttgctctttcacccagggtagagtgcagtggcgaaatcttggctcactgcaacctctgcctcccgggttcaagcaattctctgcctcagcctcctgagaagctgggattacagcgcctgccaccatgcctgtctagtttttttgtatttttagtagagacaggggtttcaccaagttggccaggctggtcttgaactcctgacctcgtgatccacccacctcggcctcccaaagtgctgggattacaggcgtgagccaccgtgccgggccagtgtttttaactgtccacacttactaaattttccagtacttcttcctatggttcatgatagtaaacacagaaacatataaggaacattattagagttaccagatgttagctgttgcatatgtgcacattcctagattcaagggtgtttttgccttaaatttaagtgggtcattggttgtcttgggaagatcatggaaaattcgggattttttagaattctgaaccaaaatatgttttgagtgtttcttagtaaatgtgtgatcttccaccttccacattcagactgcggactacacttcataaatgcctttttatttccagttatggattcaactaaatgactgccttgggagcacataattactttgctacctttttccccctttgctgttgtggctcgagtttggttctcacctgagaagatgcattgagcatatgttgttacccagccctggcttaatggtgtcctgtggggtaggggtgggaggacgaggggcacggggccagagcatgtgaatggatcatggttggacagctgtgacctgccagcactgcgggtaagcaaaactacaaaccgttctttcctctgtgacattgaataaaccttaataaaattcataattagcacatactagaaaaaa

SEQ ID NO: 38 - DNA, 4154 bp, homo sapiens
acttggacgcgcttgcggaggattgcgttgacgagactcttatttattgtcaccaacctgtggtggaatttgcagttgcacattggatctgattcgccccgccccgaatgacgcctgcccggaggcagtgaaagtacagccgcgccgccccaagtcagcctggacacataaatcagcacgcggccggagaaccccgcaatctctgcgcccacaaaatacaccgacgatgcccgatctactttaagggctgaaacccacgggcctgagagactataagagcgttccctaccgccatggaacaacggggacagaacgccccggccgcttcgggggcccggaaaaggcacggcccaggacccagggaggcgcggggagccaggcctgggccccgggtccccaagacccttgtgctcgttgtcgccgcggtcctgctgttggtctcagctgagtctgctctgatcacccaacaagacctagctccccagcagagagcggccccacaacaaaagaggtccagcccctcagagggattgtgtccacctggacaccatatctcagaagacggtagagattgcatctcctgcaaatatggacaggactatagcactcactggaatgacctccttttctgcttgcgctgcaccaggtgtgattcaggtgaagtggagctaagtccctgcaccacgaccagaaacacagtgtgtcagtgcgaagaaggcaccttccgggaagaagattctcctgagatgtgccggaagtgccgcacagggtgtcccagagggatggtcaaggtcggtgattgtacaccctggagtgacatcgaatgtgtccacaaagaatcaggtacaaagcacagtggggaagtcccagctgtggaggagacggtgacctccagcccagggactcctgcctctccctgttctctctcaggcatcatcataggagtcacagttgcagccgtagtcttgattgtggctgtgtttgtttgcaagtctttactgtggaagaaagtccttccttacctgaaaggcatctgctcaggtggtggtggggaccctgagcgtgtggacagaagctcacaacgacctggggctgaggacaatgtcctcaatgagatcgtgagtatcttgcagcccacccaggtccctgagcaggaaatggaagtccaggagccagcagagccaacaggtgtcaacatgttgtcccccggggagtcagagcatctgctggaaccggcagaagctgaaaggtctcagaggaggaggctgctggttccagcaaatgaaggtgatcccactgagactctgagacagtgcttcgatgactttgcagacttggtgccctttgactcctgggagccgctcatgaggaagttgggcctcatggacaatgagataaaggtggctaaagctgaggcagcgggccacagggacaccttgtacacgatgctgataaagtgggtcaacaaaaccgggcgagatgcctctgtccacaccctgctggatgccttggagacgctgggagagagacttgccaagcagaagattgaggaccacttgttgagctctggaaagttcatgtatctagaaggtaatgcagactctgccatgtcctaagtgtgattctcttcaggaagtcagaccttccctggtttaccttttttctggaaaaagcccaactggactccagtcagtaggaaagtgccacaattgtcacatgaccggtactggaagaaactctcccatccaacatcacccagtggatggaacatcctgtaacttttcactgcacttggcattatttttataagctgaatgtgataataaggacactatggaaatgtctggatcattccgtttgtgcgtactttgagatttggtttgggatgtcattgttttcacagcacttttttatcctaatgtaaatgctttatttatttatttgggctacattgtaagatccatctacacagtcgttgtccgacttcacttgatactatatgatatgaaccttttttgggtggggggtgcggggcagttcactctgtctcccaggctggagtgcaatggtgcaatcttggctcactatagccttgacctctcaggctcaagcgattctcccacctcagccatccaaatagctgggaccacaggtgtgcaccaccacgcccggctaattttttgtattttgtctagatataggggctctctatgttgctcagggtggtctcgaattcctggactcaagcagtctgcccacctcagactcccaaagcggtggaattagaggcgtgagcccccatgcttggccttacctttctacttttataattctgtatgttattattttatgaacatgaagaaactttagtaaatgtacttgtttacatagttatgtgaatagattagataaacataaaaggaggagacatacaatgggggaagaagaagaagtcccctgtaagatgtcactgtctgggttccagccctccctcagatgtactttggcttcaatgattggcaacttctacaggggccagtcttttgaactggacaaccttacaagtatatgagtattatttataggtagttgtttacatatgagtcgggaccaaagagaactggatccacgtgaagtcctgtgtgtggctggtccctacctgggcagtctcatttgcacccatagcccccatctatggacaggctgggacagaggcagatgggttagatcacacataacaatagggtctatgtcatatcccaagtgaacttgagccctgtttgggctcaggagatagaagacaaaatctgtctcccacgtctgccatggcatcaagggggaagagtagatggtgcttgagaatggtgtgaaatggttgccatctcaggagtagatggcccggctcacttctggttatctgtcaccctgagcccatgagctgccttttagggtacagattgcctacttgaggaccttggccgctctgtaagcatctgactcatctcagaaatgtcaattcttaaacactgtggcaacaggacctagaatggctgacgcattaaggttttcttcttgtgtcctgttctattattgttttaagacctcagtaaccatttcagcctctttccagcaaacccttctccatagtatttcagtcatggaaggatcatttatgcaggtagtcattccaggagtttttggtcttttctgtctcaaggcattgtgtgttttgttccgggactggtttgggtgggacaaagttagaattgcctgaagatcacacattcagactgttgtgtctgtggagttttaggagtggggggtgacctttctggtctttgcacttccatcctctcccacttccatctggcatcccacgcgttgtcccctgcacttctggaaggcacagggtgctgctgcctcctggtctttgcctttgctgggccttctgtgcaggacgctcagcctcagggctcagaaggtgccagtccggtcccaggtcccttgtcccttccacagaggccttcctagaagatgcatctagagtgtcagccttatcagtgtttaagatttttcttttatttttaatttttttgagacagaatctcactctctcgcccaggctggagtgcaacggtacgatcttggctcagtgcaacctccgcctcctgggttcaagcgattctcgtgcctcagcctccggagtagctgggattgcaggcacccgccaccacgcctggctaatttttgtatttttagtagagacggggtttcaccatgttggtcaggctggtctcgaactcctgacctcaggtgatccaccttggcctccgaaagtgctgggattacaggcgtgagccaccagccaggccaagctattcttttaaagtaagcttcctgacgacatgaaataattgggggttttgttgtttagttacattaggctttgctatatccccaggccaaatagcatgtgacacaggacagccatagtatagtgtgtcactcgtggttggtgtcctttcatgcttctgccctgtcaaaggtccctatttgaaatgtgttataatacaaacaaggaagcacattgtgtacaaaatacttatgtatttatgaatccatgaccaaattaaatatgaaaccttatataaaaa

SEQ ID NO: 39 - DNA, 4067 bp, homo sapiens
acttggacgcgcttgcggaggattgcgttgacgagactcttatttattgtcaccaacctgtggtggaatttgcagttgcacattggatctgattcgccccgccccgaatgacgcctgcccggaggcagtgaaagtacagccgcgccgccccaagtcagcctggacacataaatcagcacgcggccggagaaccccgcaatctctgcgcccacaaaatacaccgacgatgcccgatctactttaagggctgaaacccacgggcctgagagactataagagcgttccctaccgccatggaacaacggggacagaacgccccggccgcttcgggggcccggaaaaggcacggcccaggacccagggaggcgcggggagccaggcctgggccccgggtccccaagacccttgtgctcgttgtcgccgcggtcctgctgttggtctcagctgagtctgctctgatcacccaacaagacctagctccccagcagagagcggccccacaacaaaagaggtccagcccctcagagggattgtgtccacctggacaccatatctcagaagacggtagagattgcatctcctgcaaatatggacaggactatagcactcactggaatgacctccttttctgcttgcgctgcaccaggtgtgattcaggtgaagtggagctaagtccctgcaccacgaccagaaacacagtgtgtcagtgcgaagaaggcaccttccgggaagaagattctcctgagatgtgccggaagtgccgcacagggtgtcccagagggatggtcaaggtcggtgattgtacaccctggagtgacatcgaatgtgtccacaaagaatcaggcatcatcataggagtcacagttgcagccgtagtcttgattgtggctgtgtttgtttgcaagtctttactgtggaagaaagtccttccttacctgaaaggcatctgctcaggtggtggtggggaccctgagcgtgtggacagaagctcacaacgacctggggctgaggacaatgtcctcaatgagatcgtgagtatcttgcagcccacccaggtccctgagcaggaaatggaagtccaggagccagcagagccaacaggtgtcaacatgttgtcccccggggagtcagagcatctgctggaaccggcagaagctgaaaggtctcagaggaggaggctgctggttccagcaaatgaaggtgatcccactgagactctgagacagtgcttcgatgactttgcagacttggtgccctttgactcctgggagccgctcatgaggaagttgggcctcatggacaatgagataaaggtggctaaagctgaggcagcgggccacagggacaccttgtacacgatgctgataaagtgggtcaacaaaaccgggcgagatgcctctgtccacaccctgctggatgccttggagacgctgggagagagacttgccaagcagaagattgaggaccacttgttgagctctggaaagttcatgtatctagaaggtaatgcagactctgccatgtcctaagtgtgattctcttcaggaagtcagaccttccctggtttaccttttttctggaaaaagcccaactggactccagtcagtaggaaagtgccacaattgtcacatgaccggtactggaagaaactctcccatccaacatcacccagtggatggaacatcctgtaacttttcactgcacttggcattatttttataagctgaatgtgataataaggacactatggaaatgtctggatcattccgtttgtgcgtactttgagatttggtttgggatgtcattgttttcacagcacttttttatcctaatgtaaatgctttatttatttatttgggctacattgtaagatccatctacacagtcgttgtccgacttcacttgatactatatgatatgaaccttttttgggtggggggtgcggggcagttcactctgtctcccaggctggagtgcaatggtgcaatcttggctcactatagccttgacctctcaggctcaagcgattctcccacctcagccatccaaatagctgggaccacaggtgtgcaccaccacgcccggctaattttttgtattttgtctagatataggggctctctatgttgctcagggtggtctcgaattcctggactcaagcagtctgcccacctcagactcccaaagcggtggaattagaggcgtgagcccccatgcttggccttacctttctacttttataattctgtatgttattattttatgaacatgaagaaactttagtaaatgtacttgtttacatagttatgtgaatagattagataaacataaaaggaggagacatacaatgggggaagaagaagaagtcccctgtaagatgtcactgtctgggttccagccctccctcagatgtactttggcttcaatgattggcaacttctacaggggccagtcttttgaactggacaaccttacaagtatatgagtattatttataggtagttgtttacatatgagtcgggaccaaagagaactggatccacgtgaagtcctgtgtgtggctggtccctacctgggcagtctcatttgcacccatagcccccatctatggacaggctgggacagaggcagatgggttagatcacacataacaatagggtctatgtcatatcccaagtgaacttgagccctgtttgggctcaggagatagaagacaaaatctgtctcccacgtctgccatggcatcaagggggaagagtagatggtgcttgagaatggtgtgaaatggttgccatctcaggagtagatggcccggctcacttctggttatctgtcaccctgagcccatgagctgccttttagggtacagattgcctacttgaggaccttggccgctctgtaagcatctgactcatctcagaaatgtcaattcttaaacactgtggcaacaggacctagaatggctgacgcattaaggttttcttcttgtgtcctgttctattattgttttaagacctcagtaaccatttcagcctctttccagcaaacccttctccatagtatttcagtcatggaaggatcatttatgcaggtagtcattccaggagtttttggtcttttctgtctcaaggcattgtgtgttttgttccgggactggtttgggtgggacaaagttagaattgcctgaagatcacacattcagactgttgtgtctgtggagttttaggagtggggggtgacctttctggtctttgcacttccatcctctcccacttccatctggcatcccacgcgttgtcccctgcacttctggaaggcacagggtgctgctgcctcctggtctttgcctttgctgggccttctgtgcaggacgctcagcctcagggctcagaaggtgccagtccggtcccaggtcccttgtcccttccacagaggccttcctagaagatgcatctagagtgtcagccttatcagtgtttaagatttttcttttatttttaatttttttgagacagaatctcactctctcgcccaggctggagtgcaacggtacgatcttggctcagtgcaacctccgcctcctgggttcaagcgattctcgtgcctcagcctccggagtagctgggattgcaggcacccgccaccacgcctggctaatttttgtatttttagtagagacggggtttcaccatgttggtcaggctggtctcgaactcctgacctcaggtgatccaccttggcctccgaaagtgctgggattacaggcgtgagccaccagccaggccaagctattcttttaaagtaagcttcctgacgacatgaaataattgggggttttgttgtttagttacattaggctttgctatatccccaggccaaatagcatgtgacacaggacagccatagtatagtgtgtcactcgtggttggtgtcctttcatgcttctgccctgtcaaaggtccctatttgaaatgtgttataatacaaacaaggaagcacattgtgtacaaaatacttatgtatttatgaatccatgaccaaattaaatatgaaaccttatataaaaa

SEQ ID NO: 40 - DNA, 6564 bp, homo sapiens
ccaggcggcgttgcggccccggccccggctccctgcgccgccgccgccgccgccgccagcgctagcgccagcagccgggcccgatcacccgccgcccggtgcccgccgccgcccgcgccagcaaccgggcccgatcacccgccgcccggtgcccgccgccgcccgcgccaccggcatggcgctccggggcttctgcagcgccgatggctccgacccgctctgggactggaatgtcacgtggaataccagcaaccccgacttcaccaagtgctttcagaacacggtcctcgtgtgggtgccttgtttttacctctgggcctgtttccccttctacttcctctatctctcccgacatgaccgaggctacattcagatgacacctctcaacaaaaccaaaactgccttgggatttttgctgtggatcgtctgctgggcagacctcttctactctttctgggaaagaagtcggggcatattcctggccccagtgtttctggtcagcccaactctcttgggcatcaccatgctgcttgctacctttttaattcagctggagaggaggaagggagttcagtcttcagggatcatgctcactttctggctggtagccctagtgtgtgccctagccatcctgagatccaaaattatgacagccttaaaagaggatgcccaggtggacctgtttcgtgacatcactttctacgtctacttttccctcttactcattcagctcgtcttgtcctgtttctcagatcgctcacccctgttctcggaaaccatccacgaccctaatccctgcccagagtccagcgcttccttcctgtcgaggatcaccttctggtggatcacagggttgattgtccggggctaccgccagcccctggagggcagtgacctctggtccttaaacaaggaggacacgtcggaacaagtcgtgcctgttttggtaaagaactggaagaaggaatgcgccaagactaggaagcagccggtgaaggttgtgtactcctccaaggatcctgcccagccgaaagagagttccaaggtggatgcgaatgaggaggtggaggctttgatcgtcaagtccccacagaaggagtggaacccctctctgtttaaggtgttatacaagacctttgggccctacttcctcatgagcttcttcttcaaggccatccacgacctgatgatgttttccgggccgcagatcttaaagttgctcatcaagttcgtgaatgacacgaaggccccagactggcagggctacttctacaccgtgctgctgtttgtcactgcctgcctgcagaccctcgtgctgcaccagtacttccacatctgcttcgtcagtggcatgaggatcaagaccgctgtcattggggctgtctatcggaaggccctggtgatcaccaattcagccagaaaatcctccacggtcggggagattgtcaacctcatgtctgtggacgctcagaggttcatggacttggccacgtacattaacatgatctggtcagcccccctgcaagtcatccttgctctctacctcctgtggctgaatctgggcccttccgtcctggctggagtggcggtgatggtcctcatggtgcccgtcaatgctgtgatggcgatgaagaccaagacgtatcaggtggcccacatgaagagcaaagacaatcggatcaagctgatgaacgaaattctcaatgggatcaaagtgctaaagctttatgcctgggagctggcattcaaggacaaggtgctggccatcaggcaggaggagctgaaggtgctgaagaagtctgcctacctgtcagccgtgggcaccttcacctgggtctgcacgccctttctggtggccttgtgcacatttgccgtctacgtgaccattgacgagaacaacatcctggatgcccagacagccttcgtgtctttggccttgttcaacatcctccggtttcccctgaacattctccccatggtcatcagcagcatcgtgcaggcgagtgtctccctcaaacgcctgaggatctttctctcccatgaggagctggaacctgacagcatcgagcgacggcctgtcaaagacggcgggggcacgaacagcatcaccgtgaggaatgccacattcacctgggccaggagcgaccctcccacactgaatggcatcaccttctccatccccgaaggtgctttggtggccgtggtgggccaggtgggctgcggaaagtcgtccctgctctcagccctcttggctgagatggacaaagtggaggggcacgtggctatcaagggctccgtggcctatgtgccacagcaggcctggattcagaatgattctctccgagaaaacatcctttttggatgtcagctggaggaaccatattacaggtccgtgatacaggcctgtgccctcctcccagacctggaaatcctgcccagtggggatcggacagagattggcgagaagggcgtgaacctgtctgggggccagaagcagcgcgtgagcctggcccgggccgtgtactccaacgctgacatttacctcttcgatgatcccctctcagcagtggatgcccatgtgggaaaacacatctttgaaaatgtgattggccccaaggggatgctgaagaacaagacgcggatcttggtcacgcacagcatgagctacttgccgcaggtggacgtcatcatcgtcatgagtggcggcaagatctctgagatgggctcctaccaggagctgctggctcgagacggcgccttcgctgagttcctgcgtacctatgccagcacagagcaggagcaggatgcagaggagaacggggtcacgggcgtcagcggtccagggaaggaagcaaagcaaatggagaatggcatgctggtgacggacagtgcagggaagcaactgcagagacagctcagcagctcctcctcctatagtggggacatcagcaggcaccacaacagcaccgcagaactgcagaaagctgaggccaagaaggaggagacctggaagctgatggaggctgacaaggcgcagacagggcaggtcaagctttccgtgtactgggactacatgaaggccatcggactcttcatctccttcctcagcatcttccttttcatgtgtaaccatgtgtccgcgctggcttccaactattggctcagcctctggactgatgaccccatcgtcaacgggactcaggagcacacgaaagtccggctgagcgtctatggagccctgggcatttcacaagggatcgccgtgtttggctactccatggccgtgtccatcggggggatcttggcttcccgctgtctgcacgtggacctgctgcacagcatcctgcggtcacccatgagcttctttgagcggacccccagtgggaacctggtgaaccgcttctccaaggagctggacacagtggactccatgatcccggaggtcatcaagatgttcatgggctccctgttcaacgtcattggtgcctgcatcgttatcctgctggccacgcccatcgccgccatcatcatcccgccccttggcctcatctacttcttcgtccagaggttctacgtggcttcctcccggcagctgaagcgcctcgagtcggtcagccgctccccggtctattcccatttcaacgagaccttgctgggggtcagcgtcattcgagccttcgaggagcaggagcgcttcatccaccagagtgacctgaaggtggacgagaaccagaaggcctattaccccagcatcgtggccaacaggtggctggccgtgcggctggagtgtgtgggcaactgcatcgttctgtttgctgccctgtttgcggtgatctccaggcacagcctcagtgctggcttggtgggcctctcagtgtcttactcattgcaggtcaccacgtacttgaactggctggttcggatgtcatctgaaatggaaaccaacatcgtggccgtggagaggctcaaggagtattcagagactgagaaggaggcgccctggcaaatccaggagacagctccgcccagcagctggccccaggtgggccgagtggaattccggaactactgcctgcgctaccgagaggacctggacttcgttctcaggcacatcaatgtcacgatcaatgggggagaaaaggtcggcatcgtggggcggacgggagctgggaagtcgtccctgaccctgggcttatttcggatcaacgagtctgccgaaggagagatcatcatcgatggcatcaacatcgccaagatcggcctgcacgacctccgcttcaagatcaccatcatcccccaggaccctgttttgttttcgggttccctccgaatgaacctggacccattcagccagtactcggatgaagaagtctggacgtccctggagctggcccacctgaaggacttcgtgtcagcccttcctgacaagctagaccatgaatgtgcagaaggcggggagaacctcagtgtcgggcagcgccagcttgtgtgcctagcccgggccctgctgaggaagacgaagatccttgtgttggatgaggccacggcagccgtggacctggaaacggacgacctcatccagtccaccatccggacacagttcgaggactgcaccgtcctcaccatcgcccaccggctcaacaccatcatggactacacaagggtgatcgtcttggacaaaggagaaatccaggagtacggcgccccatcggacctcctgcagcagagaggtcttttctacagcatggccaaagacgccggcttggtgtgagccccagagctggcatatctggtcagaactgcagggcctatatgccagcgcccagggaggagtcagtacccctggtaaaccaagcctcccacactgaaaccaaaacataaaaaccaaacccagacaaccaaaacatattcaaagcagcagccaccgccatccggtcccctgcctggaactggctgtgaagacccaggagagacagagatgcgaaccacccaaaacacgcacaccctgcccctggtgccctgagacagacacacagcctcacgcccccaggaatgcaagtggtttcctggtgcttcccacggaggagttttggcagccagacttctggaggaattggttgtatagaagatcctagtgaccaaattcagcctactgcctcggatctctccagccgaagtctgtggactgcaagtctttgagatgcttctggctcccatcacctctaacatccttgtctgggtctaccaggaacgcttcatttccttggggctgcagttttgtggttgaggggcctggagaaaatcattttctccccttggcagtgtcccagggccctggatggtcctcttaccaacatctggtcttccaggcactcaaaagctgggaaccagcatctcagcgccagctctaccagttctcgttttgggccagaggcagcctctgcactcccacgcctgtcctcctggaagggacctggttggactaacggctaacctggacctggaactgtagggccaggggattgtctcagggccgacgttccacctggggcttccctccccacccaccccgactccaggctttcccttttttcttttgttcaacattgtaagaacaatcaatgctgttattactgttcccaccatgattgatgtggggtaaatattaaggagatggcctcatgggaatttgaccttgactagaaatagagactgagagtgagcaaccagctggaaggtactatgccagtcctagcagaaaaatgtgttaggggcctggcccaaagcagtgttggttgcttacagtgttgattgattttgttcttttttcttaccacctcttttctttccctctcatggtacctgctcatggttatgaagctttcaaagtaaagaacacgaaatacctcccaagtattaccagtgggtaccaaaaaaatgtccccttgagtcttttccttgtttttagatgttaattctctcccttggcatccggttagccccccagggggggcagcattgtggagaacttgatatttagttactgatgctcttccaggacacgaaaagaacccatctttgaatatcaatgattttttttttttaagtactgttccggggagaaaaacagtctcaaaacttgaacttcttgggaatagaagtgttgggctgagaagtaacattcccaggaaatagtgagaagctcgccctgtgtttgaaaccgtgttggtctctgtgttcctggaagaaaacagggaagcagcatcttttaaagcctgttctttaaggtgtctcgttagagcccaaagtggaatccggaaggcagccagagctgaggctgccccaagactcagacttgctaagaattacgccgccgacttcaaacccagagagcatctttcttttaggcgaaaacgcatatatttattttttgtaagttataccattctttcacattagataaactaagttttgggggatccttttgtaatgacttacactggaaatgcgaacatttgcagtaaaaaaatatatatatatctatatattttatttctttctaaa

SEQ ID NO: 41 - DNA, 1958 bp, homo sapiens
gcggaggcggctccggcgcccgctctgcccgccgctgggtccgaccgcgctcgccttccttgcagccgcgcctcggccccatggacgccctgtgcggttccggggagctcggctccaagttctgggactccaacctgtctgtgcacacagaaaacccggacctcactccctgcttccagaactccctgctggcctgggtgccctgcatctacctgtgggtcgccctgccctgctacttgctctacctgcggcaccattgtcgtggctacatcatcctctcccacctgtccaagctcaagatggtcctgggtgtcctgctgtggtgcgtctcctgggcggaccttttttactccttccatggcctggtccatggccgggcccctgcccctgttttctttgtcacccccttggtggtgggggtcaccatgctgctggccaccctgctgatacagtatgagcggctgcagggcgtacagtcttcgggggtcctcattatcttctggttcctgtgtgtggtctgcgccatcgtcccattccgctccaagatccttttagccaaggcagagggtgagatctcagaccccttccgcttcaccaccttctacatccactttgccctggtactctctgccctcatcttggcctgcttcagggagaaacctccatttttctccgcaaagaatgtcgaccctaacccctaccctgagaccagcgctggctttctctcccgcctgtttttctggtggttcacaaagatggccatctatggctaccggcatcccctggaggagaaggacctctggtccctaaaggaagaggacagatcccagatggtggtgcagcagctgctggaggcatggaggaagcaggaaaagcagacggcacgacacaaggcttcagcagcacctgggaaaaatgcctccggcgaggacgaggtgctgctgggtgcccggcccaggccccggaagccctccttcctgaaggccctgctggccaccttcggctccagcttcctcatcagtgcctgcttcaagcttatccaggacctgctctccttcatcaatccacagctgctcagcatcctgatcaggtttatctccaaccccatggccccctcctggtggggcttcctggtggctgggctgatgttcctgtgctccatgatgcagtcgctgatcttacaacactattaccactacatctttgtgactggggtgaagtttcgtactgggatcatgggtgtcatctacaggaaggctctggttatcaccaactcagtcaaacgtgcgtccactgtgggggaaattgtcaacctcatgtcagtggatgcccagcgcttcatggaccttgcccccttcctcaatctgctgtggtcagcacccctgcagatcatcctggcgatctacttcctctggcagaacctaggtccctctgtcctggctggagtcgctttcatggtcttgctgattccactcaacggagctgtggccgtgaagatgcgcgccttccaggtaaagcaaatgaaattgaaggactcgcgcatcaagctgatgagtgagatcctgaacggcatcaaggtgctgaagctgtacgcctgggagcccagcttcctgaagcaggtggagggcatcaggcagggtgagctccagctgctgcgcacggcggcctacctccacaccacaaccaccttcacctggatgtgcagccccttcctggtgaggcttggcacagggctgggtccctgcctccagggctctgggtgcccaggcatggccagggctcattggactctaccctgacaccacctccacgctgctcaggtgaccctgatcaccctctgggtgtacgtgtacgtggacccaaacaatgtgctggacgccgagaaaaaaaaaaaaaaaaaaaaaaaaaaaaaaaaaaaaaaaaaaaaaaaaaaaaaaaaaaaaaaaaaaaaaaaaaaa

SEQ ID NO: 42 - DNA, 5183 bp, homo sapiens
gcggaggcggctccggcgcccgctctgcccgccgctgggtccgaccgcgctcgccttccttgcagccgcgcctcggccccatggacgccctgtgcggttccggggagctcggctccaagttctgggactccaacctgtctgtgcacacagaaaacccggacctcactccctgcttccagaactccctgctggcctgggtgccctgcatctacctgtgggtcgccctgccctgctacttgctctacctgcggcaccattgtcgtggctacatcatcctctcccacctgtccaagctcaagatggtcctgggtgtcctgctgtggtgcgtctcctgggcggaccttttttactccttccatggcctggtccatggccgggcccctgcccctgttttctttgtcacccccttggtggtgggggtcaccatgctgctggccaccctgctgatacagtatgagcggctgcagggcgtacagtcttcgggggtcctcattatcttctggttcctgtgtgtggtctgcgccatcgtcccattccgctccaagatccttttagccaaggcagagggtgagatctcagaccccttccgcttcaccaccttctacatccactttgccctggtactctctgccctcatcttggcctgcttcagggagaaacctccatttttctccgcaaagaatgtcgaccctaacccctaccctgagaccagcgctggctttctctcccgcctgtttttctggtggttcacaaagatggccatctatggctaccggcatcccctggaggagaaggacctctggtccctaaaggaagaggacagatcccagatggtggtgcagcagctgctggaggcatggaggaagcaggaaaagcagacggcacgacacaaggcttcagcagcacctgggaaaaatgcctccggcgaggacgaggtgctgctgggtgcccggcccaggccccggaagccctccttcctgaaggccctgctggccaccttcggctccagcttcctcatcagtgcctgcttcaagcttatccaggacctgctctccttcatcaatccacagctgctcagcatcctgatcaggtttatctccaaccccatggccccctcctggtggggcttcctggtggctgggctgatgttcctgtgctccatgatgcagtcgctgatcttacaacactattaccactacatctttgtgactggggtgaagtttcgtactgggatcatgggtgtcatctacaggaaggctctggttatcaccaactcagtcaaacgtgcgtccactgtgggggaaattgtcaacctcatgtcagtggatgcccagcgcttcatggaccttgcccccttcctcaatctgctgtggtcagcacccctgcagatcatcctggcgatctacttcctctggcagaacctaggtccctctgtcctggctggagtcgctttcatggtcttgctgattccactcaacggagctgtggccgtgaagatgcgcgccttccaggtaaagcaaatgaaattgaaggactcgcgcatcaagctgatgagtgagatcctgaacggcatcaaggtgctgaagctgtacgcctgggagcccagcttcctgaagcaggtggagggcatcaggcagggtgagctccagctgctgcgcacggcggcctacctccacaccacaaccaccttcacctggatgtgcagccccttcctggtgaccctgatcaccctctgggtgtacgtgtacgtggacccaaacaatgtgctggacgccgagaaggcctttgtgtctgtgtccttgtttaatatcttaagacttcccctcaacatgctgccccagttaatcagcaacctgactcaggccagtgtgtctctgaaacggatccagcaattcctgagccaagaggaacttgacccccagagtgtggaaagaaagaccatctccccaggctatgccatcaccatacacagtggcaccttcacctgggcccaggacctgccccccactctgcacagcctagacatccaggtcccgaaaggggcactggtggccgtggtggggcctgtgggctgtgggaagtcctccctggtgtctgccctgctgggagagatggagaagctagaaggcaaagtgcacatgaagggctccgtggcctatgtgccccagcaggcatggatccagaactgcactcttcaggaaaacgtgcttttcggcaaagccctgaaccccaagcgctaccagcagactctggaggcctgtgccttgctagctgacctggagatgctgcctggtggggatcagacagagattggagagaagggcattaacctgtctgggggccagcggcagcgggtcagtctggctcgagctgtttacagtgatgccgatattttcttgctggatgacccactgtccgcggtggactctcatgtggccaagcacatctttgaccacgtcatcgggccagaaggcgtgctggcaggcaagacgcgagtgctggtgacgcacggcattagcttcctgccccagacagacttcatcattgtgctagctgatggacaggtgtctgagatgggcccgtacccagccctgctgcagcgcaacggctcctttgccaactttctctgcaactatgcccccgatgaggaccaagggcacctggaggacagctggaccgcgttggaaggtgcagaggataaggaggcactgctgattgaagacacactcagcaaccacacggatctgacagacaatgatccagtcacctatgtggtccagaagcagtttatgagacagctgagtgccctgtcctcagatggggagggacagggtcggcctgtaccccggaggcacctgggtccatcagagaaggtgcaggtgacagaggcgaaggcagatggggcactgacccaggaggagaaagcagccattggcactgtggagctcagtgtgttctgggattatgccaaggccgtggggctctgtaccacgctggccatctgtctcctgtatgtgggtcaaagtgcggctgccattggagccaatgtgtggctcagtgcctggacaaatgatgccatggcagacagtagacagaacaacacttccctgaggctgggcgtctatgctgctttaggaattctgcaagggttcttggtgatgctggcagccatggccatggcagcgggtggcatccaggctgcccgtgtgttgcaccaggcactgctgcacaacaagatacgctcgccacagtccttctttgacaccacaccatcaggccgcatcctgaactgcttctccaaggacatctatgtcgttgatgaggttctggcccctgtcatcctcatgctgctcaattccttcttcaacgccatctccactcttgtggtcatcatggccagcacgccgctcttcactgtggtcatcctgcccctggctgtgctctacaccttagtgcagcgcttctatgcagccacatcacggcaactgaagcggctggaatcagtcagccgctcacctatctactcccacttttcggagacagtgactggtgccagtgtcatccgggcctacaaccgcagccgggattttgagatcatcagtgatactaaggtggatgccaaccagagaagctgctacccctacatcatctccaaccggtggctgagcatcggagtggagttcgtggggaactgcgtggtgctctttgctgcactatttgccgtcatcgggaggagcagcctgaacccggggctggtgggcctttctgtgtcctactccttgcaggtgacatttgctctgaactggatgatacgaatgatgtcagatttggaatctaacatcgtggctgtggagagggtcaaggagtactccaagacagagacagaggcgccctgggtggtggaaggcagccgccctcccgaaggttggcccccacgtggggaggtggagttccggaattattctgtgcgctaccggccgggcctagacctggtgctgagagacctgagtctgcatgtgcacggtggcgagaaggtggggatcgtgggccgcactggggctggcaagtcttccatgaccctttgcctgttccgcatcctggaggcggcaaagggtgaaatccgcattgatggcctcaatgtggcagacatcggcctccatgacctgcgctctcagctgaccatcatcccgcaggaccccatcctgttctcggggaccctgcgcatgaacctggaccccttcggcagctactcagaggaggacatttggtgggctttggagctgtcccacctgcacacgtttgtgagctcccagccggcaggcctggacttccagtgctcagagggcggggagaatctcagcgtgggccagaggcagctcgtgtgcctggcccgagccctgctccgcaagagccgcatcctggttttagacgaggccacagctgccatcgacctggagactgacaacctcatccaggctaccatccgcacccagtttgatacctgcactgtcctgaccatcgcacaccggcttaacactatcatggactacaccagggtcctggtcctggacaaaggagtagtagctgaatttgattctccagccaacctcattgcagctagaggcatcttctacgggatggccagagatgctggacttgcctaaaatatattcctgagatttcctcctggcctttcctggttttcatcaggaaggaaatgacaccaaatatgtccgcagaatggacttgatagcaaacactgggggcaccttaagattttgcacctgtaaagtgccttacagggtaactgtgctgaatgctttagatgaggaaatgatccccaagtggtgaatgacacgcctaaggtcacagctagtttgagccagttagactagtccccggtctcccgattcccaactgagtgttatttgcacactgcactgttttcaaataacgattttatgaaatgacctctgtcctccctctgatttttcatattttctaaagtttcgtttctgttttttaataaaaagctttttcctcctggaacagaagacagctgctgggtcaggccacccctaggaactcagtcctgtactctggggtgctgcctgaatccattaaaaatgggagtactgatgaaataaaactacatggtcaacagtaaaaaaaaaaaaaaaaaa

SEQ ID NO: 43 - DNA, 3979 bp, homo sapiens
atttgaaaacttggcaaccttggattggatggattcatatttcttagtatagaagttcttgatataactgaaaaattaagttaaacacttaataagtggtggttactcagcacttttagatgctgtttataatagatgaccttttctaactaatttacagttttttgaaagataactgagaggttgagggacggagattttcttcaagcaattttttttttcattttaaatgagctcccaatgtcggagtttggaaaacaaatttgtctttttaaaagaaggtctaggaaactcaaaacctgaagaattggaagaaatcagaatagaaaatggtaggataagttctgaacgtcgaaaagaaaagtctcgagatgcagccagatctcggcgaagtaaagaatctgaagttttttatgagcttgctcatcagttgccacttccacataatgtgagttcgcatcttgataaggcctctgtgatgaggcttaccatcagctatttgcgtgtgaggaaacttctggatgctggtgatttggatattgaagatgacatgaaagcacagatgaattgcttttatttgaaagccttggatggttttgttatggttctcacagatgatggtgacatgatttacatttctgataatgtgaacaaatacatgggattaactcagtttgaactaactggacacagtgtgtttgattttactcatccatgtgaccatgaggaaatgagagaaatgcttacacacagaaatggccttgtgaaaaagggtaaagaacaaaacacacagcgaagcttttttctcagaatgaagtgtaccctaactagccgaggaagaactatgaacataaagtctgcaacatggaaggtattgcactgcacaggccacattcacgtatatgataccaacagtaaccaacctcagtgtgggtataagaaaccacctatgacctgcttggtgctgatttgtgaacccattcctcacccatcaaatattgaaattcctttagatagcaagactttcctcagtcgacacagcctggatatgaaattttcttattgtgatgaaagaattaccgaattgatgggatatgagccagaagaacttttaggccgctcaatttatgaatattatcatgctttggactctgatcatctgaccaaaactcatcatgatatgtttactaaaggacaagtcaccacaggacagtacaggatgcttgccaaaagaggtggatatgtctgggttgaaactcaagcaactgtcatatataacaccaagaattctcaaccacagtgcattgtatgtgtgaattacgttgtgagtggtattattcagcacgacttgattttctcccttcaacaaacagaatgtgtccttaaaccggttgaatcttcagatatgaaaatgactcagctattcaccaaagttgaatcagaagatacaagtagcctctttgacaaacttaagaaggaacctgatgctttaactttgctggccccagccgctggagacacaatcatatctttagattttggcagcaacgacacagaaactgatgaccagcaacttgaggaagtaccattatataatgatgtaatgctcccctcacccaacgaaaaattacagaatataaatttggcaatgtctccattacccaccgctgaaacgccaaagccacttcgaagtagtgctgaccctgcactcaatcaagaagttgcattaaaattagaaccaaatccagagtcactggaactttcttttaccatgccccagattcaggatcagacacctagtccttccgatggaagcactagacaaagttcacctgagcctaatagtcccagtgaatattgtttttatgtggatagtgatatggtcaatgaattcaagttggaattggtagaaaaactttttgctgaagacacagaagcaaagaacccattttctactcaggacacagatttagacttggagatgttagctccctatatcccaatggatgatgacttccagttacgttccttcgatcagttgtcaccattagaaagcagttccgcaagccctgaaagcgcaagtcctcaaagcacagttacagtattccagcagactcaaatacaagaacctactgctaatgccaccactaccactgccaccactgatgaattaaaaacagtgacaaaagaccgtatggaagacattaaaatattgattgcatctccatctcctacccacatacataaagaaactactagtgccacatcatcaccatatagagatactcaaagtcggacagcctcaccaaacagagcaggaaaaggagtcatagaacagacagaaaaatctcatccaagaagccctaacgtgttatctgtcgctttgagtcaaagaactacagttcctgaggaagaactaaatccaaagatactagctttgcagaatgctcagagaaagcgaaaaatggaacatgatggttcactttttcaagcagtaggaattggaacattattacagcagccagacgatcatgcagctactacatcactttcttggaaacgtgtaaaaggatgcaaatctagtgaacagaatggaatggagcaaaagacaattattttaataccctctgatttagcatgtagactgctggggcaatcaatggatgaaagtggattaccacagctgaccagttatgattgtgaagttaatgctcctatacaaggcagcagaaacctactgcagggtgaagaattactcagagctttggatcaagttaactgagctttttcttaatttcattcctttttttggacactggtggctcattacctaaagcagtctatttatattttctacatctaattttagaagcctggctacaatactgcacaaacttggttagttcaattttgatcccctttctacttaatttacattaatgctcttttttagtatgttctttaatgctggatcacagacagctcattttctcagttttttggtatttaaaccattgcattgcagtagcatcattttaaaaaatgcacctttttatttatttatttttggctagggagtttatccctttttcgaattatttttaagaagatgccaatataatttttgtaagaaggcagtaacctttcatcatgatcataggcagttgaaaaatttttacaccttttttttcacattttacataaataataatgctttgccagcagtacgtggtagccacaattgcacaatatattttcttaaaaaataccagcagttactcatggaatatattctgcgtttataaaactagtttttaagaagaaattttttttggcctatgaaattgttaaacctggaacatgacattgttaatcatataataatgattcttaaatgctgtatggtttattatttaaatgggtaaagccatttacataatatagaaagatatgcatatatctagaaggtatgtggcatttatttggataaaattctcaattcagagaaatcatctgatgtttctatagtcactttgccagctcaaaagaaaacaataccctatgtagttgtggaagtttatgctaatattgtgtaactgatattaaacctaaatgttctgcctaccctgttggtataaagatattttgagcagactgtaaacaagaaaaaaaaaatcatgcattcttagcaaaattgcctagtatgttaatttgctcaaaatacaatgtttgattttatgcactttgtcgctattaacatcctttttttcatgtagatttcaataattgagtaattttagaagcattattttaggaatatatagttgtcacagtaaatatcttgttttttctatgtacattgtacaaatttttcattccttttgctctttgtggttggatctaacactaactgtattgttttgttacatcaaataaacatcttctgtggaccaggcaaaaaaaaaaaaaaaaaaaaaaa

SEQ ID NO: 44 - DNA, 4082 bp, homo sapiens
gcgcgcgccggcctgggcaggcgagcgggcgcgctcccgccccctctcccctccccgcgcgcccgagcgcgcctccgcccttgcccgccccctgacgctgcctcagctcctcagtgcacagtgctgcctcgtctgaggggacaggaggatcaccctcttcgtcgcttcggccagtgtgtcgggctgggccctgacaagccacctgaggagaggctcggagccgggcccggaccccggcgattgccgcccgcttctctctagtctcacgaggggtttcccgcctcgcacccccacctctggacttgcctttccttctcttctccgcgtgtggagggagccagcgcttaggccggagcgagcctgggggccgcccgccgtgaagacatcgcggggaccgattcaccatggagggcgccggcggcgcgaacgacaagaaaaagataagttctgaacgtcgaaaagaaaagtctcgagatgcagccagatctcggcgaagtaaagaatctgaagttttttatgagcttgctcatcagttgccacttccacataatgtgagttcgcatcttgataaggcctctgtgatgaggcttaccatcagctatttgcgtgtgaggaaacttctggatgctggtgatttggatattgaagatgacatgaaagcacagatgaattgcttttatttgaaagccttggatggttttgttatggttctcacagatgatggtgacatgatttacatttctgataatgtgaacaaatacatgggattaactcagtttgaactaactggacacagtgtgtttgattttactcatccatgtgaccatgaggaaatgagagaaatgcttacacacagaaatggccttgtgaaaaagggtaaagaacaaaacacacagcgaagcttttttctcagaatgaagtgtaccctaactagccgaggaagaactatgaacataaagtctgcaacatggaaggtattgcactgcacaggccacattcacgtatatgataccaacagtaaccaacctcagtgtgggtataagaaaccacctatgacctgcttggtgctgatttgtgaacccattcctcacccatcaaatattgaaattcctttagatagcaagactttcctcagtcgacacagcctggatatgaaattttcttattgtgatgaaagaattaccgaattgatgggatatgagccagaagaacttttaggccgctcaatttatgaatattatcatgctttggactctgatcatctgaccaaaactcatcatgatatgtttactaaaggacaagtcaccacaggacagtacaggatgcttgccaaaagaggtggatatgtctgggttgaaactcaagcaactgtcatatataacaccaagaattctcaaccacagtgcattgtatgtgtgaattacgttgtgagtggtattattcagcacgacttgattttctcccttcaacaaacagaatgtgtccttaaaccggttgaatcttcagatatgaaaatgactcagctattcaccaaagttgaatcagaagatacaagtagcctctttgacaaacttaagaaggaacctgatgctttaactttgctggccccagccgctggagacacaatcatatctttagattttggcagcaacgacacagaaactgatgaccagcaacttgaggaagtaccattatataatgatgtaatgctcccctcacccaacgaaaaattacagaatataaatttggcaatgtctccattacccaccgctgaaacgccaaagccacttcgaagtagtgctgaccctgcactcaatcaagaagttgcattaaaattagaaccaaatccagagtcactggaactttcttttaccatgccccagattcaggatcagacacctagtccttccgatggaagcactagacaaagttcacctgagcctaatagtcccagtgaatattgtttttatgtggatagtgatatggtcaatgaattcaagttggaattggtagaaaaactttttgctgaagacacagaagcaaagaacccattttctactcaggacacagatttagacttggagatgttagctccctatatcccaatggatgatgacttccagttacgttccttcgatcagttgtcaccattagaaagcagttccgcaagccctgaaagcgcaagtcctcaaagcacagttacagtattccagcagactcaaatacaagaacctactgctaatgccaccactaccactgccaccactgatgaattaaaaacagtgacaaaagaccgtatggaagacattaaaatattgattgcatctccatctcctacccacatacataaagaaactactagtgccacatcatcaccatatagagatactcaaagtcggacagcctcaccaaacagagcaggaaaaggagtcatagaacagacagaaaaatctcatccaagaagccctaacgtgttatctgtcgctttgagtcaaagaactacagttcctgaggaagaactaaatccaaagatactagctttgcagaatgctcagagaaagcgaaaaatggaacatgatggttcactttttcaagcagtaggaattggaacattattacagcagccagacgatcatgcagctactacatcactttcttggaaacgtgtaaaaggatgcaaatctagtgaacagaatggaatggagcaaaagacaattattttaataccctctgatttagcatgtagactgctggggcaatcaatggatgaaagtggattaccacagctgaccagttatgattgtgaagttaatgctcctatacaaggcagcagaaacctactgcagggtgaagaattactcagagctttggatcaagttaactgagctttttcttaatttcattcctttttttggacactggtggctcattacctaaagcagtctatttatattttctacatctaattttagaagcctggctacaatactgcacaaacttggttagttcaattttgatcccctttctacttaatttacattaatgctcttttttagtatgttctttaatgctggatcacagacagctcattttctcagttttttggtatttaaaccattgcattgcagtagcatcattttaaaaaatgcacctttttatttatttatttttggctagggagtttatccctttttcgaattatttttaagaagatgccaatataatttttgtaagaaggcagtaacctttcatcatgatcataggcagttgaaaaatttttacaccttttttttcacattttacataaataataatgctttgccagcagtacgtggtagccacaattgcacaatatattttcttaaaaaataccagcagttactcatggaatatattctgcgtttataaaactagtttttaagaagaaattttttttggcctatgaaattgttaaacctggaacatgacattgttaatcatataataatgattcttaaatgctgtatggtttattatttaaatgggtaaagccatttacataatatagaaagatatgcatatatctagaaggtatgtggcatttatttggataaaattctcaattcagagaaatcatctgatgtttctatagtcactttgccagctcaaaagaaaacaataccctatgtagttgtggaagtttatgctaatattgtgtaactgatattaaacctaaatgttctgcctaccctgttggtataaagatattttgagcagactgtaaacaagaaaaaaaaaatcatgcattcttagcaaaattgcctagtatgttaatttgctcaaaatacaatgtttgattttatgcactttgtcgctattaacatcctttttttcatgtagatttcaataattgagtaattttagaagcattattttaggaatatatagttgtcacagtaaatatcttgttttttctatgtacattgtacaaatttttcattccttttgctctttgtggttggatctaacactaactgtattgttttgttacatcaaataaacatcttctgtggaccaggcaaaaaaaaaaaaaaaaaaaaaaa

SEQ ID NO: 45 - DNA, 4095 bp, homo sapiens
agacagccagttcctctcccgccgcgccgggccgcgctgccgctcgctccccggccgtggcgcctccgggccagacgcgctgcagcctccagcccgcggcaagcggggcggccgcgccacccccggccccgcgccagcagcccctcgccgcgcgtccagcgttcccggccagcagcctccccatacgcaggtcctgctgggccgccccgtcgcgccccccactctgaactcaagtcaccgtggagctccgccgccccgaaactttcaccgcgagcgggaaatatgggatgtataaaatcaaaagggaaagacagcttgagtgacgatggagtagatttgaagactcaaccagttccagaatctcagcttttacctggacagaggtttcaaactaaagatccagaggaacaaggagacattgtggtagccttgtacccctatgatggcatccacccggacgacttgtctttcaagaaaggagagaagatgaaagtcctggaggagcatggagaatggtggaaagcaaagtcccttttaacaaaaaaagaaggcttcatccccagcaactatgtggccaaactcaacaccttagaaacagaagagtggtttttcaaggatataaccaggaaggacgcagaaaggcagcttttggcaccaggaaatagcgctggagctttccttattagagaaagtgaaacattaaaaggaagcttctctctgtctgtcagagactttgaccctgtgcatggtgatgttattaagcactacaaaattagaagtctggataatgggggctattacatctctccacgaatcacttttccctgtatcagcgacatgattaaacattaccaaaagcaggcagatggcttgtgcagaagattggagaaggcttgtattagtcccaagccacagaagccatgggataaagatgcctgggagatcccccgggagtccatcaagttggtgaaaaggcttggcgctgggcagtttggggaagtctggatgggttactataacaacagtaccaaggtggctgtgaaaaccctgaagccaggaactatgtctgtgcaagccttcctggaagaagccaacctcatgaagaccctgcagcatgacaagctcgtgaggctctacgctgtggtcaccagggaggagcccatttacatcatcaccgagtacatggccaagggcagtttgctggatttcctgaagagcgatgaaggtggcaaagtgctgcttccaaagctcattgacttttctgctcagattgcagagggaatggcatacatcgagcggaagaactacattcaccgggacctgcgagcagctaatgttctggtctccgagtcactcatgtgcaaaattgcagattttggccttgctagagtaattgaagataatgagtacacagcaagggaaggtgctaagttccctattaagtggacggctccagaagcaatcaactttggatgtttcactattaagtctgatgtgtggtcctttggaatcctcctatacgaaattgtcacctatgggaaaattccctacccagggagaactaatgccgacgtgatgaccgccctgtcccagggctacaggatgccccgtgtggagaactgcccagatgagctctatgacattatgaaaatgtgctggaaagaaaaggcagaagagagaccaacgtttgactacttacagagcgtcctggatgatttctacacagccacggaagggcaataccagcagcagccttagagcacagggagacccgtccatttggcaggggtggctgcctcatttagagaggaaaagtaaccatcactggttgcacttatgatttcatgtgcggggatcatctgccgtgcctggatcctgaaatagaggctaaattactcaggaagaacaccctctaaatgggaaagtattctgtactcttagatggattctccactcagttgcaacttggacttgtcctcagcagctggtaatcttgctctgcttgacaacatctgagtgcagccgtttgagaagaaaacatctattctctccaaaaatgcacccaactagctctatgtttacaaatggacataggactcaaagtttcagagaccattgcaatgaatccccaataattgcagaactaaactcatttataaagctaaaataaccggatatatacatagcatgacatttctttgtgctttggcttacttgtttaaaaaaaaaaaaaaactaatccaacctgttagattttgcaggtgaagtcagcagcttaaaaatgtctttcccagatttcaatgatttttttccccctacctcccaaaatctgagactgttaaaacatttttcttctatgaacactgctcagacctgctagacatgccataggagtggcgtgcacatctctctctcttccagcaggaggagcccgtgagcacgcacagctgccctgtctgctcacccgaaggcaccgggctcacctggacctcccaggaaagggagaagagcctcagaaactgctctgtgtttagaaggaatatttttaagagtccagctttttcatttccacaatttcctatatccagatttgttttgacaatgtagtttggaagaactaagattctaatctctgaagaaccttatagggccttctaaaacataagagtttcctttgttgcttcaaatatttgaacattatgttaaagatcaagtattaattttagttgtactctagaaagctaaagtgccacattcggggctatttttatgattcagcaatcttttctaaattgtgtagcatgtgtatgagactatttatacccaaggatatgaaggaacataagtgactacaaggctctaataagccacggtggcaggaggttcaagcggttctgttcactaaatttttctcctgtaagctttgaatggaaacttctgtatcacatgatgtgtttcacttatgctgttgtgtatatacctaatatttctatttttgattttattttaatacacctcgtccaataacatctcaagctttttatttgcatttacattttcagctgtggtcagtgtaaaaattggtcatcagctgggggcggggtggttagaagtgattcaacagagctacatgctttaaacttgcccaagttctacctccttcctttgaacatttcagattggagaaccaaggagttgattgcctgaacacctgaacatccgtttatgggggccagatagaatttgttttcaaataggcttaacaggcatcattaaaatttcattctgtgtgttttgtttaggcttgaggtgcttagaagatgggataaaatattctacttttttctaaattttaactttgtttcctatgtgatttttttaaatgtcctttctaaaatattctaaaattattgattcacaagtgccatgttcagaactatagaatattactgttacataatgtctgcacagctggtcccttgattcagtggtaaggtttttgtgtacacccccctgcttgcattttatttcagaaccacaagtattacccaatatgttacatggagaggaactataaagaatccctaaggcaaaaagaagtctctagaaaatgactagaggttttttttttagcataacaaatttatttaaagaaaattattaaatttatcttcgccttgttttgcttctcccagttcctcctcttcttgccattttccacttgtctttccctcccaatcaagcctgtgatccttacctccatgtgggcccttcaccagcttgggcctcatctctggtgtccagcatgtgtggaagtcacacgttcccttgatgaacagcacacacagtctccttacttagctataggtttccagcctccctgtgacagacaggcataatgaggggctgaataggtgtttgtagcattttcgggtatccagtggtgtgcaaaatggctcatgtcatcacacctcaggttattgtagagaactggaaagacagaatccatactccctaccgccaagattctgacttagctgttgtgcagcgggagatgtatgtcagtctattttaaaagcttctccagtcagctag

SEQ ID NO: 46 - DNA, 4158 bp, homo sapiens
agacagccagttcctctcccgccgcgccgggccgcgctgccgctcgctccccggccgtggcgcctccgggccagacgcgctgcagcctccagcccgcggcaagcggggcggccgcgccacccccggccccgcgccagcagcccctcgccgcgcgtccagcgttcccggccagcagcctccccatacgcaggtcctgctgggccgccccgtcgcgccccccactctgaactcaagtcaccgtggagctccgccgccccgaaactttcaccgcgagcgggaaatatgggatgtataaaatcaaaagggaaagacagcttgagtgacgatggagtagatttgaagactcaaccagtacgtaatactgaaagaactatttatgtgagagatccaacgtccaataaacagcaaaggccagttccagaatctcagcttttacctggacagaggtttcaaactaaagatccagaggaacaaggagacattgtggtagccttgtacccctatgatggcatccacccggacgacttgtctttcaagaaaggagagaagatgaaagtcctggaggagcatggagaatggtggaaagcaaagtcccttttaacaaaaaaagaaggcttcatccccagcaactatgtggccaaactcaacaccttagaaacagaagagtggtttttcaaggatataaccaggaaggacgcagaaaggcagcttttggcaccaggaaatagcgctggagctttccttattagagaaagtgaaacattaaaaggaagcttctctctgtctgtcagagactttgaccctgtgcatggtgatgttattaagcactacaaaattagaagtctggataatgggggctattacatctctccacgaatcacttttccctgtatcagcgacatgattaaacattaccaaaagcaggcagatggcttgtgcagaagattggagaaggcttgtattagtcccaagccacagaagccatgggataaagatgcctgggagatcccccgggagtccatcaagttggtgaaaaggcttggcgctgggcagtttggggaagtctggatgggttactataacaacagtaccaaggtggctgtgaaaaccctgaagccaggaactatgtctgtgcaagccttcctggaagaagccaacctcatgaagaccctgcagcatgacaagctcgtgaggctctacgctgtggtcaccagggaggagcccatttacatcatcaccgagtacatggccaagggcagtttgctggatttcctgaagagcgatgaaggtggcaaagtgctgcttccaaagctcattgacttttctgctcagattgcagagggaatggcatacatcgagcggaagaactacattcaccgggacctgcgagcagctaatgttctggtctccgagtcactcatgtgcaaaattgcagattttggccttgctagagtaattgaagataatgagtacacagcaagggaaggtgctaagttccctattaagtggacggctccagaagcaatcaactttggatgtttcactattaagtctgatgtgtggtcctttggaatcctcctatacgaaattgtcacctatgggaaaattccctacccagggagaactaatgccgacgtgatgaccgccctgtcccagggctacaggatgccccgtgtggagaactgcccagatgagctctatgacattatgaaaatgtgctggaaagaaaaggcagaagagagaccaacgtttgactacttacagagcgtcctggatgatttctacacagccacggaagggcaataccagcagcagccttagagcacagggagacccgtccatttggcaggggtggctgcctcatttagagaggaaaagtaaccatcactggttgcacttatgatttcatgtgcggggatcatctgccgtgcctggatcctgaaatagaggctaaattactcaggaagaacaccctctaaatgggaaagtattctgtactcttagatggattctccactcagttgcaacttggacttgtcctcagcagctggtaatcttgctctgcttgacaacatctgagtgcagccgtttgagaagaaaacatctattctctccaaaaatgcacccaactagctctatgtttacaaatggacataggactcaaagtttcagagaccattgcaatgaatccccaataattgcagaactaaactcatttataaagctaaaataaccggatatatacatagcatgacatttctttgtgctttggcttacttgtttaaaaaaaaaaaaaaactaatccaacctgttagattttgcaggtgaagtcagcagcttaaaaatgtctttcccagatttcaatgatttttttccccctacctcccaaaatctgagactgttaaaacatttttcttctatgaacactgctcagacctgctagacatgccataggagtggcgtgcacatctctctctcttccagcaggaggagcccgtgagcacgcacagctgccctgtctgctcacccgaaggcaccgggctcacctggacctcccaggaaagggagaagagcctcagaaactgctctgtgtttagaaggaatatttttaagagtccagctttttcatttccacaatttcctatatccagatttgttttgacaatgtagtttggaagaactaagattctaatctctgaagaaccttatagggccttctaaaacataagagtttcctttgttgcttcaaatatttgaacattatgttaaagatcaagtattaattttagttgtactctagaaagctaaagtgccacattcggggctatttttatgattcagcaatcttttctaaattgtgtagcatgtgtatgagactatttatacccaaggatatgaaggaacataagtgactacaaggctctaataagccacggtggcaggaggttcaagcggttctgttcactaaatttttctcctgtaagctttgaatggaaacttctgtatcacatgatgtgtttcacttatgctgttgtgtatatacctaatatttctatttttgattttattttaatacacctcgtccaataacatctcaagctttttatttgcatttacattttcagctgtggtcagtgtaaaaattggtcatcagctgggggcggggtggttagaagtgattcaacagagctacatgctttaaacttgcccaagttctacctccttcctttgaacatttcagattggagaaccaaggagttgattgcctgaacacctgaacatccgtttatgggggccagatagaatttgttttcaaataggcttaacaggcatcattaaaatttcattctgtgtgttttgtttaggcttgaggtgcttagaagatgggataaaatattctacttttttctaaattttaactttgtttcctatgtgatttttttaaatgtcctttctaaaatattctaaaattattgattcacaagtgccatgttcagaactatagaatattactgttacataatgtctgcacagctggtcccttgattcagtggtaaggtttttgtgtacacccccctgcttgcattttatttcagaaccacaagtattacccaatatgttacatggagaggaactataaagaatccctaaggcaaaaagaagtctctagaaaatgactagaggttttttttttagcataacaaatttatttaaagaaaattattaaatttatcttcgccttgttttgcttctcccagttcctcctcttcttgccattttccacttgtctttccctcccaatcaagcctgtgatccttacctccatgtgggcccttcaccagcttgggcctcatctctggtgtccagcatgtgtggaagtcacacgttcccttgatgaacagcacacacagtctccttacttagctataggtttccagcctccctgtgacagacaggcataatgaggggctgaataggtgtttgtagcattttcgggtatccagtggtgtgcaaaatggctcatgtcatcacacctcaggttattgtagagaactggaaagacagaatccatactccctaccgccaagattctgacttagctgttgtgcagcgggagatgtatgtcagtctattttaaaagcttctccagtcagctag

SEQ ID NO: 47 - DNA, 1413 bp, homo sapiens
ttgtgattgtttttagtttgttagctgcctggagtgttattttaagaaagcagaagcaccatcatttgcacactccttatagatcacacaccttaaccctgactttttttgctccagtttttcagaagaagtgaagtcaagatgaagaaccatttgcttttctggggagtcctggcggtttttattaaggctgttcatgtgaaagcccaagaagatgaaaggattgttcttgttgacaacaaatgtaagtgtgcccggattacttccaggatcatccgttcttccgaagatcctaatgaggacattgtggagagaaacatccgaattattgttcctctgaacaacagggagaatatctctgatcccacctcaccattgagaaccagatttgtgtaccatttgtctgacctctgtaaaaaatgtgatcctacagaagtggagctggataatcagatagttactgctacccagagcaatatctgtgatgaagacagtgctacagagacctgctacacttatgacagaaacaagtgctacacagctgtggtcccactcgtatatggtggtgagaccaaaatggtggaaacagccttaaccccagatgcctgctatcctgactaatttaagtcattgctgactgcatagctctttttcttgagaggctctccattttgattcagaaagttagcatatttattaccaatgaatttgaaaccagggcttttttttttttttgggtgatgtaaaaccaactccctgccaccaaaataattaaaatagtcacattgttatctttattaggtaatcacttcttaattatatgttcatactctaagtatcaaaatcttccaattatcatgctcacctgaaagaggtatgctctcttaggaatacagtttctagcattaaacaaataaacaaggggagaaaataaaactcaaggactgaaaatcaggaggtgtaataaaatgttcctcgcattcccccccgcttttttttttttttttgactttgccttggagagccagagcttccgcattttctttactattctttttaaaaaaagtttcactgtgtagagaacatatatgcataaacataggtcaattatatgtctccattagaaaaataataattggaaaacatgttctagaactagttacaaaaataatttaaggtgaaatctctaatatttataaaagtagcaaaataaatgcataattaaaatatatttggacataacagacttggaagcagatgatacagacttctttttttcataatcaggttagtgtaagaaattgccatttgaaacaatccattttgtaactgaaccttatgaaatatatgtatttcatggtacgtattctctagcacagtctgagcaattaaatagattcataagcataaaaa

SEQ ID NO: 48 - DNA, 4778 bp, homo sapiens
gggaggccgactgagcaggagtcgtccgcttatagtggaggctgctaggagccggtcagaggcatcgagagtaaacatgaggttacgatcctgggaggacttaatgaatttgtagtgaagttttatggaccacaaggaacaccatatgaaggcggagtatggaaagttagagtggacctacctgataaataccctttcaaatctccatctataggattcatgaataaaattttccatcccaacattgatgaagcgtcaggaactgtgtgtctagatgtaattaatcaaacttggacagctctctatgatcttaccaatatatttgagtccttcctgcctcagttattggcctatcctaaccccatagatcctctcaatggtgacgctgcagccatgtacctccaccgaccagaagaatacaagcagaaaattaaagagtacatccagaaatacgccacggaggaggcgctgaaagaacaggaagagggtaccggggacagctcatcggagagctctatgtctgacttttccgaagatgaggcccaggatatggagttgtagtagaaaaagcacctgcttttcagaaagactattatttcctaaccatgagaagcagactataatattcatatttaaacaaagcaattttttttattactaaacaaggtttttatgaataatagcattgatatatatatattatatatcaccctttagatcttgatttcttggtcatttctcaacctgaggtgcatagcatattcccacattccatttggtagcaatatgcggtctgaatgcatgcattcatgagtccatgtggccaagtcagcctgtgtgctactgaactgtcgaaggaaatagccgctctgataggtagatgtgagtaaaaagaacaggaaaaaattgcttcttttattggtttccaaagaaacaaaccaaaccaaccagctcttggatgtgaagataaaatagtgcttttttgaaatggagaggaaaaacttggggaggaagaggcctgctgtgggggcatcggagccagccatgtaagaatcagagctgctccttcctgtgaatcctaggtggccctatgtcttctgtggagttacagtataaagcagggagctaattaagagtattaaaacttaaaaccattttttgactctgattttaagtacatttttatatgtcagttgctgcccttcacactaccaggccctgcagccacagtgttctgttggagaaacttggggaagtgttttctgaaccagttctttttcttggggtagagcgtgaaatccagacctgtttttgaaaggacagcacaggaggagaaaagtgactgggacgatgcttcctctcatccaaaacacatgcagagtcacatcctcatcctagtgtttggcagtttgagaccgctaccctgaacttaagagctttaaatatgagggttgtgtttctgggggggttatttttttggtgtgtgtgtgtgtgtattgtgcttagaaaggttgcagatttcatcttcacctaccaagaggcggccgcctccttggacaagccgctcatggaccattagacttgagaagacgacccacgtggtgactgcaaagccctgggtacttgccttcatgttctggtttggttttccctttttctgctgctcttggcagcagcctggtcatcatctgcttgtgggagtgggaaatgggtattttagacccaacacaggttctaaatttaaaacaaataataattggaacaaataaaggttcttgtacccagagtgattctacatgggaaaaacaaaccagcttttttcagagagtgaccgaataggaagaagggattcagaaatatgatgtagtagaacatgccctgcaggaagaaaatgttttctctcctgcgtatgttaagaggaaatcagtttaaaatgcctgctaatcaaatgtcgactcagctaaccatatgtccaggttgctgcagagtttctttcaaatctgagtgttgcctgctgaactcggaggggagtttggagaaattttagacagcagctctgtgttctttttttgccgcagccaataagataatagcagaattagccaatcctaaaaccttctaaagacgatttttgagcatcccactgggattatttaatttttctttttgacgtgtgtttttagtttagaagtgctgtattccacaaggtttaagtcagtgaggttggaagataccctatcttttttattcaaaaagcacaatcaatcttttgtttgaaaatctatataaagtacaacttgcttttagcatgattattttcctaaataaaaagacaaagaatttacttactttatgttaattacgggcatgaagcaaaaggttttctttaaaaaaaaaaaaaagtgcagtgatgtagggctgtggttagttaaccgtactgagttatccatctagcatctgtggcttgctggaagggtagtattaactatttaacatgtaatggtgtacttcactcttacctagcacgctgtcttctcattgctttgggggagggagggtctctctgctggcactgtctaacttgcttacctgctgactttgcagtttgcttgtgctatgacatttattgtaggtgctatttagggtaggcttaaagtgctgggtggtgatttgagttcaaacaataaaaaattgtattttttcaatattgtataaacaatagtgttctaattaccttaaaaaaaaataatgaccagttaagaattgcttttgatcttgtcaaaaaactgaatagaccccagtttcgggaaggtgtgtgagcagtgccatgactctgccccttacctaatcccacatctctctaatgataagacattggctcgcctctgaccagagccccagcaccagagagcggaagatgcagaattgtcaaatgacctgctgggggaggttgtaggagtttagcagatttgagtgtggctgcagagagagagagtgtgtgtatgtgtgcacatgtgtgagagtgtgagcgagagtgtgtgtgtgtccatctaagtgtgtgtgatgaaggtgggataaggctcctctgttagtgctggaagctcctgtaattgccgcatggatcccactgtgccctcttgttctgtgcaagtctgtcctgtctgggcactaaccttggtcccatgcatgtttatgttctgggtggggctttgcctctccactgggaaactgacttttgctgggttgaacagagtcccttatgctttttgtcctctccctgcgcctgggagaggtgggagtaggagcccaaacacacaggtacagaaagatctggaagaaggcctggcagtgaatccaaggactctgggcccccaacaatagatggtagcgtaagtctggagcagcggtgtttcaccaccaaatgcctttccaggctgcccttccaacactcaggagagcatccagatccctgggcagaggctctacattcttggctttagaggtggtggcagcggcagcaggtcagagccacttctggcggtttccctcccctttttagtgcccatagtttttggatcctcccttgagttttaccagcacaagccattctttgcccctgttcacataactgagctcaagctcttgccaaacaccaacaagcaagatggttgcaacctggcaacattgaatccaccacccttgggctccctctggaagccccagcaccggggggcttttgggcacagggtcagtggtagccatcttagacactgacatttggctttgtcgtcaatttcatcaccctccttgaggttactgtgcagtttcaaccagcattttatcctagtgaggtcattatcaggagttgccatatcatctctccagtacctaacatttctcatccacttcaaaagctgttctgactgccagctggctgatctaagctcctgaggaatgtctcctctcaaaggaatttttccctccaaaggccccctgaagtcctagttggcattggcctggcacatgctttatgttaggcctcccgttgggatggctgagaatcatgaaagacagatcctccgctagcctctgtgggtcaagtttctggacaccaagtctctgggaactagtgtttgattttaaatggcatgtggcccttccttgtttcagtgacttagaaaagtaaaagccatttaaaaaagttagcaagattttttatcgacttcccaactgggcttccagccttgttgaatgaaatcatctatctctgattgggcgcaacgaactgcatttctttggacttctgaatccatgtttgtgctttctctggcccgtgaacacctcggcgattctgttagggatgggatgagtgggaggaagccctttgagaagggggagccggccctgtcatgcgcaggttttccactcatctgaggaagagccagggctctgaatttagcctaacactcatcttggctgtgggcttgggaagaaatggccattatttacagattgtatttggtacatattgtgtgatacttgaaaagataaaagggactgccagcccctaactgaaatctgaagctttttatcgcttatttttcctcgccctgtctcctcccttccacctttctccttgcattgtgatgatctagtaggcacgtctgtcaacaggacacatgcctcctctgactataacctcttaatagttgtgtataatgaaaactgtaaacttttttaaataaacgtgtatataccttggcaaaaaaaaaaaaaaa

SEQ ID NO: 49 - DNA, 5174 bp, homo sapiens
agagcgaggctggggtagggaggccgactgagcaggagtcgtccgcttatagtggaggctgctaggagccggtcagagggtgagtggggagcaggcgagcgagccacagcaggcaggagggagcgtcgcgcggcgcagaggagcgccggggcagggccgcggcggaaccacagccggagaggggcagcccgagccgggcgccgcagggtccccacccccacccggccggacagtgcccggtgttcccccgtgcggggggcggcggcggcggctgacgggaccgccgggaccgcgggggtgttgccacctccaccgaggagccggcgcggccgcgggctcctcagagccggggccccgggcccgtgacagacgggccgaggaagggagagaggcggcggcgacaccatgtcatctcccagtccgggcaagaggcggatggacacggacgtggtcaagctcatcgagagtaaacatgaggttacgatcctgggaggacttaatgaatttgtagtgaagttttatggaccacaaggaacaccatatgaaggcggagtatggaaagttagagtggacctacctgataaataccctttcaaatctccatctataggattcatgaataaaattttccatcccaacattgatgaagcgtcaggaactgtgtgtctagatgtaattaatcaaacttggacagctctctatgatcttaccaatatatttgagtccttcctgcctcagttattggcctatcctaaccccatagatcctctcaatggtgacgctgcagccatgtacctccaccgaccagaagaatacaagcagaaaattaaagagtacatccagaaatacgccacggaggaggcgctgaaagaacaggaagagggtaccggggacagctcatcggagagctctatgtctgacttttccgaagatgaggcccaggatatggagttgtagtagaaaaagcacctgcttttcagaaagactattatttcctaaccatgagaagcagactataatattcatatttaaacaaagcaattttttttattactaaacaaggtttttatgaataatagcattgatatatatatattatatatcaccctttagatcttgatttcttggtcatttctcaacctgaggtgcatagcatattcccacattccatttggtagcaatatgcggtctgaatgcatgcattcatgagtccatgtggccaagtcagcctgtgtgctactgaactgtcgaaggaaatagccgctctgataggtagatgtgagtaaaaagaacaggaaaaaattgcttcttttattggtttccaaagaaacaaaccaaaccaaccagctcttggatgtgaagataaaatagtgcttttttgaaatggagaggaaaaacttggggaggaagaggcctgctgtgggggcatcggagccagccatgtaagaatcagagctgctccttcctgtgaatcctaggtggccctatgtcttctgtggagttacagtataaagcagggagctaattaagagtattaaaacttaaaaccattttttgactctgattttaagtacatttttatatgtcagttgctgcccttcacactaccaggccctgcagccacagtgttctgttggagaaacttggggaagtgttttctgaaccagttctttttcttggggtagagcgtgaaatccagacctgtttttgaaaggacagcacaggaggagaaaagtgactgggacgatgcttcctctcatccaaaacacatgcagagtcacatcctcatcctagtgtttggcagtttgagaccgctaccctgaacttaagagctttaaatatgagggttgtgtttctgggggggttatttttttggtgtgtgtgtgtgtgtattgtgcttagaaaggttgcagatttcatcttcacctaccaagaggcggccgcctccttggacaagccgctcatggaccattagacttgagaagacgacccacgtggtgactgcaaagccctgggtacttgccttcatgttctggtttggttttccctttttctgctgctcttggcagcagcctggtcatcatctgcttgtgggagtgggaaatgggtattttagacccaacacaggttctaaatttaaaacaaataataattggaacaaataaaggttcttgtacccagagtgattctacatgggaaaaacaaaccagcttttttcagagagtgaccgaataggaagaagggattcagaaatatgatgtagtagaacatgccctgcaggaagaaaatgttttctctcctgcgtatgttaagaggaaatcagtttaaaatgcctgctaatcaaatgtcgactcagctaaccatatgtccaggttgctgcagagtttctttcaaatctgagtgttgcctgctgaactcggaggggagtttggagaaattttagacagcagctctgtgttctttttttgccgcagccaataagataatagcagaattagccaatcctaaaaccttctaaagacgatttttgagcatcccactgggattatttaatttttctttttgacgtgtgtttttagtttagaagtgctgtattccacaaggtttaagtcagtgaggttggaagataccctatcttttttattcaaaaagcacaatcaatcttttgtttgaaaatctatataaagtacaacttgcttttagcatgattattttcctaaataaaaagacaaagaatttacttactttatgttaattacgggcatgaagcaaaaggttttctttaaaaaaaaaaaaaagtgcagtgatgtagggctgtggttagttaaccgtactgagttatccatctagcatctgtggcttgctggaagggtagtattaactatttaacatgtaatggtgtacttcactcttacctagcacgctgtcttctcattgctttgggggagggagggtctctctgctggcactgtctaacttgcttacctgctgactttgcagtttgcttgtgctatgacatttattgtaggtgctatttagggtaggcttaaagtgctgggtggtgatttgagttcaaacaataaaaaattgtattttttcaatattgtataaacaatagtgttctaattaccttaaaaaaaaataatgaccagttaagaattgcttttgatcttgtcaaaaaactgaatagaccccagtttcgggaaggtgtgtgagcagtgccatgactctgccccttacctaatcccacatctctctaatgataagacattggctcgcctctgaccagagccccagcaccagagagcggaagatgcagaattgtcaaatgacctgctgggggaggttgtaggagtttagcagatttgagtgtggctgcagagagagagagtgtgtgtatgtgtgcacatgtgtgagagtgtgagcgagagtgtgtgtgtgtccatctaagtgtgtgtgatgaaggtgggataaggctcctctgttagtgctggaagctcctgtaattgccgcatggatcccactgtgccctcttgttctgtgcaagtctgtcctgtctgggcactaaccttggtcccatgcatgtttatgttctgggtggggctttgcctctccactgggaaactgacttttgctgggttgaacagagtcccttatgctttttgtcctctccctgcgcctgggagaggtgggagtaggagcccaaacacacaggtacagaaagatctggaagaaggcctggcagtgaatccaaggactctgggcccccaacaatagatggtagcgtaagtctggagcagcggtgtttcaccaccaaatgcctttccaggctgcccttccaacactcaggagagcatccagatccctgggcagaggctctacattcttggctttagaggtggtggcagcggcagcaggtcagagccacttctggcggtttccctcccctttttagtgcccatagtttttggatcctcccttgagttttaccagcacaagccattctttgcccctgttcacataactgagctcaagctcttgccaaacaccaacaagcaagatggttgcaacctggcaacattgaatccaccacccttgggctccctctggaagccccagcaccggggggcttttgggcacagggtcagtggtagccatcttagacactgacatttggctttgtcgtcaatttcatcaccctccttgaggttactgtgcagtttcaaccagcattttatcctagtgaggtcattatcaggagttgccatatcatctctccagtacctaacatttctcatccacttcaaaagctgttctgactgccagctggctgatctaagctcctgaggaatgtctcctctcaaaggaatttttccctccaaaggccccctgaagtcctagttggcattggcctggcacatgctttatgttaggcctcccgttgggatggctgagaatcatgaaagacagatcctccgctagcctctgtgggtcaagtttctggacaccaagtctctgggaactagtgtttgattttaaatggcatgtggcccttccttgtttcagtgacttagaaaagtaaaagccatttaaaaaagttagcaagattttttatcgacttcccaactgggcttccagccttgttgaatgaaatcatctatctctgattgggcgcaacgaactgcatttctttggacttctgaatccatgtttgtgctttctctggcccgtgaacacctcggcgattctgttagggatgggatgagtgggaggaagccctttgagaagggggagccggccctgtcatgcgcaggttttccactcatctgaggaagagccagggctctgaatttagcctaacactcatcttggctgtgggcttgggaagaaatggccattatttacagattgtatttggtacatattgtgtgatacttgaaaagataaaagggactgccagcccctaactgaaatctgaagctttttatcgcttatttttcctcgccctgtctcctcccttccacctttctccttgcattgtgatgatctagtaggcacgtctgtcaacaggacacatgcctcctctgactataacctcttaatagttgtgtataatgaaaactgtaaacttttttaaataaacgtgtatataccttggcaaaaaaaaaaaaaaa

SEQ ID NO: 50 - DNA, 1865 bp, homo sapiens
gggttgatgacgtcagcgttcgaattccatggcggcgcggcggcgacggagcaccggcggcggcagggcgagagcattaaatgaaagcaaaagagttaataatggcaacacggctccagaagactcttcccctgccaagaaaactcgtagatgccagagacaggagtcgaaaaagatgcctgtggctggaggaaaagctaataaggacaggacagaagacaagcaagatgaatctgtgaaggccttgctgttaaagggcaaagctcctgtggacccagagtgtacagccaaggtggggaaggctcatgtgtattgtgaaggaaatgatgtctatgatgtcatgctaaatcagaccaatctccagttcaacaacaacaagtactatctgattcagctattagaagatgatgcccagaggaacttcagtgtttggatgagatggggccgagttgggaaaatgggacagcacagcctggtggcttgttcaggcaatctcaacaaggccaaggaaatctttcagaagaaattccttgacaaaacgaaaaacaattgggaagatcgagaaaagtttgagaaggtgcctggaaaatatgatatgctacagatggactatgccaccaatactcaggatgaagaggaaacaaagaaagaggaatctcttaaatctcccttgaagccagagtcacagctagatcttcgggtacaggagttaataaagttgatctgtaatgttcaggccatggaagaaatgatgatggaaatgaagtataataccaagaaagccccacttgggaagctgacagtggcacaaatcaaggcaggttaccagtctcttaagaagattgaggattgtattcgggctggccagcatggacgagctctcatggaagcatgcaatgaattctacaccaggattccgcatgactttggactccgtactcctccactaatccggacacagaaggaactgtcagaaaaaatacaattactagaggctttgggagacattgaaattgctattaagctggtgaaaacagagctacaaagcccagaacacccattggaccaacactatagaaacctacattgtgccttgcgcccccttgaccatgaaagttatgagttcaaagtgatttcccagtacctacaatctacccatgctcccacacacagcgactataccatgaccttgctggatttgtttgaagtggagaaggatggtgagaaagaagccttcagagaggaccttcataacaggatgcttctatggcatggttccaggatgagtaactgggtgggaatcttgagccatgggcttcgaattgccccacctgaagctcccatcacaggttacatgtttgggaaaggaatctactttgctgacatgtcttccaagagtgccaattactgctttgcctctcgcctaaagaatacaggactgctgctcttatcagaggtagctctaggtcagtgtaatgaactactagaggccaatcctaaggccgaaggattgcttcaaggtaaacatagcaccaaggggctgggcaagatggctcccagttctgcccacttcgtcaccctgaatgggagtacagtgccattaggaccagcaagtgacacaggaattctgaatccagatggttataccctcaactacaatgaatatattgtatataaccccaaccaggtccgtatgcggtaccttttaaaggttcagtttaatttccttcagctgtggtgaatgttgatattaaataaaccagagatctgatcttcaagcaagaaaataagcagtgttgtacttgtgaattttgtgatattttatgtaataaaaactgtacaggtctaaaaaaaaaaaaaaaaaa

SEQ ID NO: 51 - DNA, 1904 bp, homo sapiens
gggttgatgacgtcagcgttcgaattccatggcggcgcggcggcgacggagcaccggcggcggcagggcgagagcattaaatgaaagcaaaagagttaataatggcaacacggctccagaagactcttcccctgccaagaaaactcgtagatgccagagacaggagtcgaaaaagatgcctgtggctggaggaaaagctaataaggacaggacagaagacaagcaagatggtatgccaggaaggtcatgggccagcaaaagggtctctgaatctgtgaaggccttgctgttaaagggcaaagctcctgtggacccagagtgtacagccaaggtggggaaggctcatgtgtattgtgaaggaaatgatgtctatgatgtcatgctaaatcagaccaatctccagttcaacaacaacaagtactatctgattcagctattagaagatgatgcccagaggaacttcagtgtttggatgagatggggccgagttgggaaaatgggacagcacagcctggtggcttgttcaggcaatctcaacaaggccaaggaaatctttcagaagaaattccttgacaaaacgaaaaacaattgggaagatcgagaaaagtttgagaaggtgcctggaaaatatgatatgctacagatggactatgccaccaatactcaggatgaagaggaaacaaagaaagaggaatctcttaaatctcccttgaagccagagtcacagctagatcttcgggtacaggagttaataaagttgatctgtaatgttcaggccatggaagaaatgatgatggaaatgaagtataataccaagaaagccccacttgggaagctgacagtggcacaaatcaaggcaggttaccagtctcttaagaagattgaggattgtattcgggctggccagcatggacgagctctcatggaagcatgcaatgaattctacaccaggattccgcatgactttggactccgtactcctccactaatccggacacagaaggaactgtcagaaaaaatacaattactagaggctttgggagacattgaaattgctattaagctggtgaaaacagagctacaaagcccagaacacccattggaccaacactatagaaacctacattgtgccttgcgcccccttgaccatgaaagttatgagttcaaagtgatttcccagtacctacaatctacccatgctcccacacacagcgactataccatgaccttgctggatttgtttgaagtggagaaggatggtgagaaagaagccttcagagaggaccttcataacaggatgcttctatggcatggttccaggatgagtaactgggtgggaatcttgagccatgggcttcgaattgccccacctgaagctcccatcacaggttacatgtttgggaaaggaatctactttgctgacatgtcttccaagagtgccaattactgctttgcctctcgcctaaagaatacaggactgctgctcttatcagaggtagctctaggtcagtgtaatgaactactagaggccaatcctaaggccgaaggattgcttcaaggtaaacatagcaccaaggggctgggcaagatggctcccagttctgcccacttcgtcaccctgaatgggagtacagtgccattaggaccagcaagtgacacaggaattctgaatccagatggttataccctcaactacaatgaatatattgtatataaccccaaccaggtccgtatgcggtaccttttaaaggttcagtttaatttccttcagctgtggtgaatgttgatattaaataaaccagagatctgatcttcaagcaagaaaataagcagtgttgtacttgtgaattttgtgatattttatgtaataaaaactgtacaggtctaaaaaaaaaaaaaaaaaa

SEQ ID NO: 52 - DNA, 3325 bp, homo sapiens
ggggtccttggctgggcggggcttgctcgcggtggcttgtggctccttcctgcggtgcttctctctttcgctcaggcccgtggcgccgacaggatgggcaagtgtcgtggacttcgtactgctaggaagctccgtagtcaccgacgagaccagaagtggcatgataaacagtataagaaagctcatttgggcacagccctaaaggccaacccttttggaggtgcttctcatgcaaaaggaatcgtgctggaaaaagtaggagttgaagccaaacagccaaattctgccattaggaagtgtgtaagggtccagctgatcaagaatggcaagaaaatcacagcctttgtacccaatgacggttgcttgaactttattgaggaaaatgatgaagttctggttgctggatttggtcgcaaaggtcatgctgttggtgatattcctggagtccgctttaaggttgtcaaagtagccaatgtttctcttttggccctatacaaaggcaagaaggaaagaccaagatcataaatattaatggtgaaaacactgtagtaataaattttcatatgccaaaaaatgtttgtatcttactgtcccctgttctcaccacgaagatcatgttcattaccaccaccacccccccttattttttttatcctaaaccagcaaacgcaggacctgtaccaattttaggagacaataagacagggttgtttcaggattctctagagttaataacatttgtaacctggcacagtttccctcatcctgtggaataagaaaatgggatagatctggaataaatgtgcagtattgtagtattactttaagaactttaagggaacttcaaaaactcactgaaattctagtgagatactttcttttttattcttggtattttccatatcgggtgcaacacttcagttaccaaatttcattgcacatagattatcttaggtacccttggaaatgcacattcttgtatccatcttacaggggcccaagatgataaatagtaaactcaaaattgctccccactctgtttattatttaaaggtgtcaggatctgtgttgtaatgtgtctacattaatgtgtttaggagaatacaggcattggatcatttagttgatggaagtatatgccaggcaagggagataaggtatacgacaagactgatgttttcagtatcttctcatgaggttgtcagagaccttcatgtcttcaaagactagtcagcaaatgaagtggtttagtgtagagacaagattggttgtgttttgataatttaagctaggtattgagtacatgtggattttgctgtccacaaatacttgtttcagagttttcatggatacagtggcatggttgaaatgaagctgtgagccttctgctttaaatctgatgtaagaaactcctgttaacaaatagtaagtatgggttaattagccctttgatcaaagcctagctttacattgtttaggatctttggaaaacaattggtttggttgcccactttccgtaggatcaagagcagaacctttcacatggcacagaagaacccaggttgcgcttcatacctgcatattccagccttagcctgccatttctctccttggcactttgtgctccagcaacactggtctcagttggtcatcctcaaacttgggttccatatccagcctcaggacctctgttcctgttactatggttccttgcatgtcgcctgctcttactaaagagctcgtgtgttttccagcacacttcggtttatctcttgatgatgatgctagtctctccctccgcaagggcggaaaggctgcctgttggtttgtaccagtgtttcctaacgtgtagctgcagtcagtatttggctaagctgttcccaggggctcaacagatgctttcggatgagccttaactgacccaatcctttgtgatgcgggagagattgctaggcctcgctcacctggccagaaccagggaaagaggccgcggttgcagcgcgattccaggccctgggcgtcaggcgcggggtgggcagctctccccgggcggtggggcccttgtgaccgcgaggcggggcgcaccaggaagggagtgggacagcgcgggcgcccagggatgtggcctggttacctgccttctctgatacgtcaagacaccttcaacaatggcttgcagctgtaccctgttggctgcacccaggacgcccttttcactgctaagcagtcctacctgaggcccaggggctgccagattgacccataaataatctccggcgcctcagatccagaagctgctgagcctgatcttagtgccttctcctttctctgtgtggccccccagcccctttccccactgccttgtgtccaaggccctttccttcatgtatccatggaggagagacaaaaatacacatcaataaaataagatagggaatccataaatagacattcagaagtatggccaacggatttatcttaaaaccaatggaggaagaagagtttcaataaatgttgtggacttccatttgtcaaagaccaaaacaaaggaaccccaaccttacatgtaatacaaacttaactcaaaatggatcatatatctaaatgtaaaatggaaagctataaaactgaaaacagactatctttacaacctaggcgtaggtatagtttttagacattacaccaaaagcacatgccgtaaaagaaaaaatagataaattggtggatttcattaaaattaaaaaactttttctctctgaaaaatcctgttaagctgggcgctgtggttcatgcctgtaatcccagcactttgggaggctgagttgggaagaaattaatagcttgaggccaggagttcaagatcatcctgggcagcaaagtcatacactcttgagggaagagagagaccttctcatattgttttatattgttttatactcagtacctgttttaagaaaaaaacaaggaagtgaaatcaaagacaggcagcccggcaccaggcctgaaaccagccctgggcctgcctggcctaaacctagtagttaaaaatcaacttacgacttagaacctgatgttatccgtagattccaagcattgtataaaaaaattgtgaaactccctgttgtgttctgtaccagtgcatgaaacccctgtcacatatcccctagattgctcaatcaatcacgaccctttcatgtgaaatctttagtgttgtgagcccttaaaagggacagaaattgtgcacttgaggagctcagattttaaggctgtagcttgccgatgctcccagctgaataaagcccttccttctacaaaaaaaaaaaaa

SEQ ID NO: 53 - DNA, 1401 bp, homo sapiens
ggctgggactggctgagcctggcgggaggcggggtccgagtcaccgcctgccgccgcgcccccggtttctataaattgagcccgcagcctcccgcttcgctctctgctcctcctgttcgacagtcagccgcatcttcttttgcgtcgccagccgagccacatcgctcagacaccatggggaaggtgaaggtcggagtcaacggatttggtcgtattgggcgcctggtcaccagggctgcttttaactctggtaaagtggatattgttgccatcaatgaccccttcattgacctcaactacatggtttacatgttccaatatgattccacccatggcaaattccatggcaccgtcaaggctgagaacgggaagcttgtcatcaatggaaatcccatcaccatcttccaggagcgagatccctccaaaatcaagtggggcgatgctggcgctgagtacgtcgtggagtccactggcgtcttcaccaccatggagaaggctggggctcatttgcaggggggagccaaaagggtcatcatctctgccccctctgctgatgcccccatgttcgtcatgggtgtgaaccatgagaagtatgacaacagcctcaagatcatcagcaatgcctcctgcaccaccaactgcttagcacccctggccaaggtcatccatgacaactttggtatcgtggaaggactcatgaccacagtccatgccatcactgccacccagaagactgtggatggcccctccgggaaactgtggcgtgatggccgcggggctctccagaacatcatccctgcctctactggcgctgccaaggctgtgggcaaggtcatccctgagctgaacgggaagctcactggcatggccttccgtgtccccactgccaacgtgtcagtggtggacctgacctgccgtctagaaaaacctgccaaatatgatgacatcaagaaggtggtgaagcaggcgtcggagggccccctcaagggcatcctgggctacactgagcaccaggtggtctcctctgacttcaacagcgacacccactcctccacctttgacgctggggctggcattgccctcaacgaccactttgtcaagctcatttcctggtatgacaacgaatttggctacagcaacagggtggtggacctcatggcccacatggcctccaaggagtaagacccctggaccaccagccccagcaagagcacaagaggaagagagagaccctcactgctggggagtccctgccacactcagtcccccaccacactgaatctcccctcctcacagttgccatgtagaccccttgaagaggggaggggcctagggagccgcaccttgtcatgtaccatcaataaagtaccctgtgctcaaccaaaaaaaaaaaaaaaaaaa

SEQ ID NO: 54 - DNA, 1425 bp, homo sapiens
gtgcgcagcgggtgcatccctgtccggatgctgcgcctgcggtagagcggccgccatgttgcaaccgggaaggaaatgaatgggcagccgttaggaaagcctgccggtgactaaccctgcgctcctgcctcgatgggtggagtcgcgtgtggcggggaagtcaggtggagcgaggctagctggcccgatttctcctccgggtgatgcttttcctagattattctctgatttggtcgtattgggcgcctggtcaccagggctgcttttaactctggtaaagtggatattgttgccatcaatgaccccttcattgacctcaactacatggtttacatgttccaatatgattccacccatggcaaattccatggcaccgtcaaggctgagaacgggaagcttgtcatcaatggaaatcccatcaccatcttccaggagcgagatccctccaaaatcaagtggggcgatgctggcgctgagtacgtcgtggagtccactggcgtcttcaccaccatggagaaggctggggctcatttgcaggggggagccaaaagggtcatcatctctgccccctctgctgatgcccccatgttcgtcatgggtgtgaaccatgagaagtatgacaacagcctcaagatcatcagcaatgcctcctgcaccaccaactgcttagcacccctggccaaggtcatccatgacaactttggtatcgtggaaggactcatgaccacagtccatgccatcactgccacccagaagactgtggatggcccctccgggaaactgtggcgtgatggccgcggggctctccagaacatcatccctgcctctactggcgctgccaaggctgtgggcaaggtcatccctgagctgaacgggaagctcactggcatggccttccgtgtccccactgccaacgtgtcagtggtggacctgacctgccgtctagaaaaacctgccaaatatgatgacatcaagaaggtggtgaagcaggcgtcggagggccccctcaagggcatcctgggctacactgagcaccaggtggtctcctctgacttcaacagcgacacccactcctccacctttgacgctggggctggcattgccctcaacgaccactttgtcaagctcatttcctggtatgacaacgaatttggctacagcaacagggtggtggacctcatggcccacatggcctccaaggagtaagacccctggaccaccagccccagcaagagcacaagaggaagagagagaccctcactgctggggagtccctgccacactcagtcccccaccacactgaatctcccctcctcacagttgccatgtagaccccttgaagaggggaggggcctagggagccgcaccttgtcatgtaccatcaataaagtaccctgtgctcaaccaaaaaaaaaaaaaaaaaaa

SEQ ID NO: 55 - DNA, 987 bp, homo sapiens
aatataagtggaggcgtcgcgctggcgggcattcctgaagctgacagcattcgggccgagatgtctcgctccgtggccttagctgtgctcgcgctactctctctttctggcctggaggctatccagcgtactccaaagattcaggtttactcacgtcatccagcagagaatggaaagtcaaatttcctgaattgctatgtgtctgggtttcatccatccgacattgaagttgacttactgaagaatggagagagaattgaaaaagtggagcattcagacttgtctttcagcaaggactggtctttctatctcttgtactacactgaattcacccccactgaaaaagatgagtatgcctgccgtgtgaaccatgtgactttgtcacagcccaagatagttaagtgggatcgagacatgtaagcagcatcatggaggtttgaagatgccgcatttggattggatgaattccaaattctgcttgcttgctttttaatattgatatgcttatacacttacactttatgcacaaaatgtagggttataataatgttaacatggacatgatcttctttataattctactttgagtgctgtctccatgtttgatgtatctgagcaggttgctccacaggtagctctaggagggctggcaacttagaggtggggagcagagaattctcttatccaacatcaacatcttggtcagatttgaactcttcaatctcttgcactcaaagcttgttaagatagttaagcgtgcataagttaacttccaatttacatactctgcttagaatttgggggaaaatttagaaatataattgacaggattattggaaatttgttataatgaatgaaacattttgtcatataagattcatatttacttcttatacatttgataaagtaaggcatggttgtggttaatctggtttatttttgttccacaagttaaataaatcataaaacttgatgtgttatctctta

The invention claimed is:

1. A method for the treatment of pancreatic cancer in a human patient suffering from disease related pain intensity determined to be greater than 20% with a unidimensional pain intensity assessment tool, said method comprising:
   a) using a unidimensional pain intensity assessment tool that measures disease related pain intensity to identify a human patient afflicted with pancreatic cancer who suffers from disease related pain intensity greater than 20% according to said unidimensional pain intensity assessment tool;
   b) determining that the identified human patient afflicted with pancreatic cancer is more likely to have a beneficial response to treatment with masitinib, or a pharmaceutically acceptable salt thereof, in combination with gemcitabine in comparison to a human patient afflicted with pancreatic cancer who suffers from disease related pain intensity less than 20%, wherein the beneficial response is improved chances of survival; and
   c) administering masitinib, or a pharmaceutically acceptable salt thereof, in combination with gemcitabine to the human patient afflicted with pancreatic cancer identified as suffering from disease related pain intensity greater than 20% with the unidimensional pain intensity assessment tool used in step a).

2. The method of claim 1, wherein said masitinib or a pharmaceutically acceptable salt thereof is administered at a daily dose of 4.5 to 12.0 mg/kg/day (mg per kg bodyweight per day).

3. The method of claim 1, wherein said patient is either naïve to gemcitabine or responding to treatment with gemcitabine.

4. The method of claim 1, wherein said patient is either refractory or resistant to gemcitabine.

5. The method of claim 1, wherein said pancreatic cancer is unresectable adenocarcinoma pancreatic cancer.

6. The method of claim 1, wherein said masitinib or a pharmaceutically acceptable salt thereof is administered at a starting dose of 6.0 to 7.5 mg/kg/day.

7. The method of claim 1, wherein said masitinib or a pharmaceutically acceptable salt thereof is dose escalated by increments of 1.5 mg/kg/day to reach a maximum of 12.0 mg/kg/day.

8. The method of claim 1, wherein said masitinib or a pharmaceutically acceptable salt thereof is administered orally.

9. The method of claim 1, wherein said masitinib or a pharmaceutically acceptable salt thereof is administered twice a day.

10. The method of claim 1, wherein said pharmaceutical acceptable salt of masitinib is a mesilate salt.

11. The method of claim 1, wherein the unidimensional pain intensity assessment tool used to measure disease related pain intensity in step a) is a Visual Analogue Scale (VAS) and wherein the human patient afflicted with pancreatic cancer identified as suffering from disease related pain intensity greater than 20% with said unidimensional pain intensity assessment tool is a human patient afflicted with pancreatic cancer who suffers from at least one reported occurrence of a VAS pain intensity score higher than 20 mm on a 100-mm scale.

* * * * *